(12) United States Patent
Krumlauf et al.

(10) Patent No.: US 7,968,301 B2
(45) Date of Patent: Jun. 28, 2011

(54) METHOD OF MODULATING SOST BINDING TO LRP

(75) Inventors: Robb Krumlauf, Mission Hills, KS (US); Debra Ellies, Kansas City, MO (US)

(73) Assignee: Stowers Institute for Medical Research, Kansas City, MO (US)

( * ) Notice: Subject to any disclaimer, the term of this patent is extended or adjusted under 35 U.S.C. 154(b) by 0 days.

(21) Appl. No.: 11/985,836

(22) Filed: Nov. 16, 2007

(65) Prior Publication Data

US 2008/0181898 A1  Jul. 31, 2008

Related U.S. Application Data

(62) Division of application No. 10/464,368, filed on Jun. 16, 2003, now abandoned.

(60) Provisional application No. 60/388,970, filed on Jun. 14, 2002.

(51) Int. Cl.
*G01N 33/53* (2006.01)

(52) U.S. Cl. .................................................. 435/7.1

(58) Field of Classification Search .................. None
See application file for complete search history.

(56) References Cited

U.S. PATENT DOCUMENTS

| | | | |
|---|---|---|---|
| 5,780,263 | A | 7/1998 | Hastings et al. |
| 6,395,511 | B1 | 5/2002 | Brunkow et al. |
| 6,489,445 | B1 | 12/2002 | Brunkow et al. |
| 6,495,736 | B1 | 12/2002 | Brunkow et al. |
| 6,803,453 | B1 | 10/2004 | Brunkow et al. |
| 6,875,570 | B2 | 4/2005 | Gerlach et al. |
| 7,381,409 | B2 | 6/2008 | Winkler et al. |
| 7,578,999 | B2 | 8/2009 | Winkler et al. |
| 2004/0158045 | A1 | 8/2004 | Brunkow et al. |
| 2005/0106683 | A1 | 5/2005 | Winkler et al. |
| 2007/0072797 | A1 | 3/2007 | Robinson et al. |
| 2007/0110747 | A1 | 5/2007 | Paszty et al. |
| 2008/0160060 | A1 | 7/2008 | Ellies |

FOREIGN PATENT DOCUMENTS

| | | |
|---|---|---|
| WO | WO 00/32773 | 6/2000 |
| WO | WO 01/92308 | 12/2001 |
| WO | WO 02/24888 | 3/2002 |

OTHER PUBLICATIONS

Albertsen et al., "A physical map and candidate genes in the BRCA1 region on chromosome 17q12-21," Nature Genetics, 7:472-479 (1994).
Balemans et al., "Localization of the Gene for Sclerosteosis to the van Buchem Disease-Gene Region on Chromosome 17q12-q21," Am. J. Hum. Genet., 64:1661-1669 (1999).
Bradley et al., "Modifying the Mouse: Design and Desire," Bio/Technology, 10:534-539 (1992).
Campbell et al., "Totipotency or Multipotentiality of Cultured Cells: Applications and Progress," Theriogenology, 47:63-72 (1997).
Chan et al., "New paradigm in the treatment of osteoporosis: Wnt pathway proteins and their antagonists," Current Opinion in Investigational Drugs, 8(4):293-298 (2007).
Cook et al., "Structural Basis for a Functional Antagonist in the Transforming Growth Factor β Superfamily," J. Biol. Chem., 280(48):40177-186 (2005).
Hoffman et al., "BMP Signaling Pathways in Cartilage and Bone Formation," Critical Review in Eukaryotic Gene Expression, 11(1-3):23-45 (2001).
Keller et al., "Molecular Recognition of BMP-2 and BMP Receptor IA," Nat. Struct. Mol. Biol., 11(5):481-488 (2004).
Li et al., "Sclerostin Binds to LRP5/6 and Antagonizes Canonical Wnt Signalling," Jour. Bio. Chem., 280(20); 19883-19887 (2005).
Lian et al., "Bone Formation: Osteoblast Lineage Cells, Growth Factors, Matrix Proteins, and the Mineralization Process," Primer on the Metabolic Bone Diseases and Disorders of Mineral Metabolism, 4th Edition, 14-29 (1999).
Mullins et al., "Transgenesis in the Rat and Larger Mammals," J. Clin. Invest. 97(7):1557-1560 (1996).
Oshima et al., "TGF-β Receptor Type II Deficiency ReSults in Defects of Yolk Sac Hematopoiesis and Vasculogenesis," Developmental Biology 179:297-302 (1996).
Pittenger et al., "Multilineage Potential of Adult Human Mesenchymal Stem Cells," Science 284:143-147 (1999).
Pockwinse et al., "Expression of Cell Growth and Bone Specific Genes at Single Cell Resolution During Development of Bone Tissue-Like Organization in Primary Osteoblast Cultures," Journal of Cellular Biochemistry 49:310-323 (1992).
Schmitt et al., "Bone Morphogenetic Proteins: An Update on Basic Biology and Clinical Relevance," Journal of Orthopaedic Research 17:269-278 (1999).
Smith, "TGF β inhibitors, new and unexpected requirements in vertebrate development," TIG, 15(1):3-5 (1999).
Van Bezooijen et al., "Wnt but Not BMP Signaling Is Involved in the Inhibitory Action of Sclerostin on BMP-Stimulated Bone Formation," J. Bone. Miner. Res. 22:19-28 (2007).
Non-Final Office Action mailed Sep. 17, 2009 in U.S. Appl. No. 11/508,701 (Paper No. 20090903).
Response to Non-Final Office Action mailed Sep. 17, 2009 in U.S. Appl. No. 11/508,701.
Capecchi, 1994, Scientific American, pp. 52-59.
Brunkow, et al., US 2003/0166247 A1.
Houdebine, 1994, J. Biotech, 34, pp. 269-287.
Wall, Theriogenology, 45:57-68, 1996.
Niemann, Transg. Res., 7:73-75, 1998.

(Continued)

*Primary Examiner* — Michael Pak
(74) *Attorney, Agent, or Firm* — Bryan Cave LLP

(57) ABSTRACT

The present invention relates to nucleic acid sequences and amino acid sequences which influence bone deposition, the Wnt pathway, ocular development, tooth development, and may bind to LRP. The nucleic acid sequence and polypeptides include Wise and Sost as well as a family of molecules which express a cysteine knot polypeptide. Additionally, the present invention relates to various molecular tools derived from the nucleic acids and polypeptides including vectors, transfected host cells, monochronal antibodies, Fab fragments, and methods for impacting the pathways.

9 Claims, 18 Drawing Sheets
(14 of 18 Drawing Sheet(s) Filed in Color)

OTHER PUBLICATIONS

Keri et al., PNAS, 97(1):383-38, 2000.
Brunkow et al., Am. J. Hum. Genet., 68:577-589, 2001.
Balmain et al., Trends in Genetics, 14(4):139-144, 1998.
Cameron, Molec. Biol., 7:253-265, 1997.
Aubin, J.E., et al., Monoclonal Antibodies as Tools for Studying the Osteoblast Lineage, Microscopy Research and Technique, 33:128-140 (1996).
Bachiller, D., et al., The organizer factors Chordin and Noggin are required for mouse forebrain development Nature, vol. 403 (Feb. 10, 2000).
Balemans, W., et al., Extracellular Regulation of BMP Signaling in Vertebrates: A Cocktail of Modulators, Developmental Biology 250:231-250 (2002).
Balemans, W.. et al.. Increased bone density in sclerosteosis is due to the deficiency of a novel secreted protein (SOST), Human Molecular Genetics, vol. 10 (5): 537-543 (2001).
Bork, P., The modular architecture of a new family of growth regulators related to connective tissue growth factor, FEBS Letters 327(4125-130 (Jul. 1993).
Boyden, L.M., et at, High Bone Density Due to a Mutation in LOL-Receptor-Related Protein 5, The New England Journal of Medicine. vol. 348(20). pp. 1513-1521 (May 16, 2002).
Bruder, S.P., et al., Monoclonal Antibodies Reactive With Human Osteogenic Cell Surface Antigens, Elsevier, Bone vol. 21, No. 3:225-235 (Sep. 1997).
Brunkow. M.E., et al, Bone Dysplasla Sclerosteosis Results from Loss of the SOST Gene Product, a Novel Cystine Knot-Containing Protein, Am. J. Hum. Genet. 68:577-589 (2001).
Chen, X., et al.. Thy-1 Antigen Expression by Cells in the Osteoblast Lineage, Journal of Bone and Mineral Research, 14 (3): 362-375 (1999).
Dewitt, N., Bone and Cartilage, Nature 423:315 (May 2003).
Ellies, D.L., et al., Novel Wnt Inhibitor, WISE, Affects Bone Density (manuscript).
Gong, Y., et al., LDL Receptor-Related Protein 5 (LRP5) Affects Bone Accrual and Eye Development. Cell 107: 513-523 (Nov. 16, 2001).
Hamersma, H., el at, The natural history of sclerosteosis, Clinical Genetics 63:192-197 (2003).
Harada, S., et al, Control of osteoblast function and regulation of bone mass, Nature 423:349-355 (2003).
Harris, S., et al. Human Fetal Osteoblast Progenitor Cell Lines (hFOB), http://www.mayo.edutechcomm/93010.html, visited Jun. 11, 2003.
Hartley, K.O., et al., Targeted gene expression in trasngenic *Xenopus* using the binary Ga14-UAS system, Proc. Natl. Acad. Sci. 99(3): 1377-1382, 2002.
Hartmann. C., Wnt-signaling and skeletogenesis, J. Musculoskel Neuron Interact 2(3):274-276 (2002).
Hemmati-Brivanlou, A., Vertebrate Neural Induction, Annual Review Neuroscience 20:43-60 (1997).
Hoppler, S., Wnt Signalling in *Xenopus* Development, http://www.personal.dundee.ac.uk/-sphopple/research.html, visited on May 1, 2002.
Itasaki, N.. et al., Wise, a context-dependent activator and inhibitor of Wnt signalling, Development 130:4295-4305.
Ivkovic, S., et al., Connective tissue growth factor coordinates chondrogenesis and angiogenesis during skeletal development, Development 130:2779-2791 (2003).
Karsenty G., The complexities of skeletal biology, Nature 423:316-318 (2003).
Kato. M., et al., Cbfa1-Independent decrease in osteoblast proliferation, osteopenia, and persistent embryonic eye vascularization in mice deficient inLrp5, a Wnt coreceptor, The Journal of Cell Biology, 157 (2): 303-314 (Apr. 15, 2002).
Kerszberg, M., et al., A simple molecular model of neurulation, BioEssays 20:758-770 (1998), John Wiley & Sons, Inc.
Kronenberg. H.M., et al., Developmental regulation of the growth plate, Nature 423:332-338 (2003).
Kusu, N., et al., Sclerostin is a Novel Secreted Osteoclast-Derived Bone Morphogenetic Protein (BMP) Antagonist with Unique Ligand Specificity, The American Society for Biochemistry and Molecular Biology, Inc., published on Apr. 17, 2003 as Manuscript M301716200.
Latinkic, B.V., et. al., *Xenopus* Cyr61 regulates gastrulation movements and modulates Wnt signalling. Development 130:2429-2441 (2003).
Little, R.D., et. al., A Mutation in the LDL Receptor-Related Protein 5 Gene Results in the Autosomal Dominant High-Bone-Mass Trait, The American Journal of Human Genetics 70:11-19 (2002).
Little, R.D., et. al., High Bone Density Due to a Mutation in LDL-Receptor-Related Protein 5, The New England Journal of Medicine, vol. 347(12), pp. 943-944 (Sep. 19, 2002).
Mao. B., et. al., LDL-receptor-related protein 6 is a receptor for Dickkopf proteins. Nature 411:321-325 (May 17, 2001).
Mathis, J.R., et. al., Pre-Steady-State Study of Recombinant Sesquiterpene Cyclases, Biochemistry 38:8340-8348 (1997).
McClary, K., et al., The Effects of Ascorbic Acid on the Osteoblast Extracellular Matrix, http:/lsvl.Ia.asu.edu/ubep2001/abstracts/mc-claryl, visted on Jun. 11, 2003.
McMahon, J.A., et al., Noggin-mediated antagonism of BMP signaling is required for growth and patterning of the neural tube and somite, Genes & Development 12:1438-1452, (1998).
Meitinger, T., et al., Molecular modelling of the Norrie disease protein predicts a cystine knot growth factor tertiary structure, Nature Genetics, vol. 5 (Dec. 1993).
Nijweide, P.J., et al., Identification of osteocytes in osteoblast-like cell cultures using a monoclonal antibody specifically directed against osteocytes, Histochemistry 84:342-347 (1986).
Prince, V.E., et al., Hox gene expression reveals regionalization along the anteroposterior axis of the zebrafish notochord. Dev Genes Evol 208:517-522 (1998).
Rosen, C. J., et al., Defining the Genetics of Osteoporosis: Using the Mouse to Understand Man, Osteoporosis International 12:803-810 (2001).
Segarini, P.R.. et al., The Low Density Lipoprotein Receptor-Related Protein/alpha2-Macroglobulin Receptor is a Receptor for Connective Tissue Growth Factor (CTGF), The American Society for Biochemistry and Molecular Biology, Inc., Published on Aug. 22, 2001 as Manuscript M105180200.
Simmons, D.G., et al., Uterine Sensitization-Associated Gene-1: A Novel Gene Induced Within the Rat Endometrium at the Time of Uterine Receptivity/Sensitization for the Decidual Cell Reaction, Biology of Reproduction 67:1638-1645 (2002).
Stephen. L.X.G., et al., Dental and oral manifestations of Sclerosteosis, International Dental Journal 51:287-290 (2001).
Streit, A., et al., Neural induction a bird's eye view, Trends in Genetics 15(1): 20-24 (1999).
Tamai, K, et al., LDL-receptor-related proteins in Wnt signal transduction. Nature 407:530-535 (2000).
Thisse, B., et al., Activin-and Nodel-related factors control anteroposterior patterning of the zebrafish embryo, Nature, vol. 403 (Jan. 27, 2000).
Torres, R.M., et al., The Cologne Guide to Gene Targeting (manuscript) (1995).
Wu, W., et al., Mutual antagonism between dickkopf1 and dickkopf2 regulates Wnt/beta-catenin signaling, Current Biology14-28; 10 (24) 1611-14 (2000).
Zelzer, E., et at, The genetic basis for skeletal diseases, Nature 423:343-348 (2003).
Amaya, E., et al., Expression of a Dominant Negative Mutant of the FGF Receptor Disrupts Mesoderm Formation in *Xenopus* Embryos, Cell 66:257-270 (Jul. 26, 1991).
Axelrod, J.D., et al., Differential recruitment of Dishevelled provides signaling specificity in the planar cell polarity and Wingless signaling pathways, Genes & Development 12:2610-2622 (1998).
Baker, J.C., et al., Wnt signaling in *Xenopus* embryos Inhibits Bmp4 expression and activates neural development, Genes & Development 13:3149-3159 (1999).
Beddington, R., et al., Anterior patterning in mouse, Trends in Genetics 14:277-284 (Jul. 1998).
Beddington, R., et al., Axis Development and Early Asymmetry in Mammals, Cell 98:195-209 (Jan. 22, 1999).

Blumberg, B., et al., An essential role for retinoid signaling in anteroposterior neural patterning, Development 124:373-379 (1997).
Bourguignon, C., et al., Xbf-1, winged helix transcription factor with dual activity, has a role in positioning neurogenesis in *Xenopus* competent ectoderm, Development 125:4889-4900 (1998).
Bradley, L., et al., Different Activities of the Frizzled-Rotated Proteins frzb2 and sizzled2 during *Xenopus* Anteroposterior Patterning, Developmental Biology 227:118-132 (2000).
Brannon, M., et al., A β-catentn/XTcf-3 complex binds to the slamois promoter to regulate dorsal axis specification in *Xenopus*, Genes & Development 11:2359-2370 (1997).
Cadigan, K.M., et al., Wnt signaling: a common theme in animal development, Genes & Development 11:3286-3305 (1997).
Capdevila, J., et al., Control of Dorsoventral Somite Patterning by Wnt-1 and β-Catenin, Developmental Biology 193:182-194 (1998).
Christian, J.L., et al., Interactions between Xwnt-8 and Spemann organizer signaling pathways generate dorsoventral pattern in the embryonic mesoderm of *Xenopus*. Genes & Development 7:13-28 (1993).
Condie, B.G., et at., Most of the Homeobox-Containing Xhox 36 Transcripts in Early *Xenopus* Embryos Cannot Encode a Homeodomain Protein, Molecular and Cellular Biology 10:3376-3385 (Jul. 1990).
Cox, W.G., et al., Caudalization of neural fate by tissue recombination and bFGF, Development 121:4349.4358 (1995).
Danielian, P.S., et al., Engrailed-1 as a target of the Wnt-1 signalling pathway in vertebrate midbrain development, Nature 383:332-334 (Sep. 26, 1996).
Dickinson, ME., et al., Dorsalization of the neural tube by the non-neural ectoderm, Development 121: 2099-2106 (1995).
Doniach, T., Planar and Vertical induction of anteroposterior Pattern during the Development of theamphibian Central Nervous System, Journal of Neurobiology 24 (10):1256-1275 (1993).
Ensini, M., et al., The control of rostrocaudal pattern in the developing spinal cord: specification of motor neuron subtype identity is initiated by signals from paraxial mesoderm, Development 125:969-982 (1998).
Fagotto, F., et al., Induction of the primary dorsalizing center in *Xenopus* by the Wnt/GSK/β-catenin signaling pathway, but not by Vg1, Activin or Noggin, Development 124:453-460 (1997).
Fan, M.J., et al., A role for Siamois in Spemann organizer formation, Development 124:2581-2589 (1997).
Fredieu, J.R., et al., Xwnt-8 and Lithium Can Act upon either dorsal Mesodermal or Neurectodermal Cells to Cause a Loss of Forebrain in *Xenopus* Embryos, Developmental Biology 188: 100-114 (1997).
Gavalas, A., et al., Retinoid signaling and hindbrain patterning, Cur Opin Genet Dev 10:380-386 (2000).
Glinka, A., et al., Dickkopf-1 is a member of a new family of secreted proteins and functions in head induction, Nature 391:357-382 (Jan. 22, 1998).
Glinka, A., et al., Head induction by simultaneous repression of Bmp and Wnt signaling in *Xenopus*, Nature 389:517-519 (Oct. 2, 1997).
Gould, A., et al., Initiation of Rhombomeric Hoxb4 Expression Requires Induction by Somites and a Retinoid Pathway, Neuron 21:39-51 (Jul. 1998).
Grapin-Botton, A., et al., Hox gene Induction in the neural tube depends on three parameters: competence, signal supply and paralogue group, Development 124:849-859 (1997).
Hamburger, V., et al., A series of normal stages in the development of the chick embryo, J. Morph. 88:49-92 (1951).
He, X., et al., A Member of the Frizzled Protein Family Mediating Axis Induction by Wnt-5A, Science 275:1652-1654 (Mar. 14, 1997).
Heasman, J., et al', β-Catenin Signaling Activity Dissected in the Early *Xenopus* Embryo: A Novel Antisense Approach, Developmental Biology 222:124-134 (2000).
Heisenberg, C.P., et al., Silberblick/Wnt11 mediates convergent extension movements during zebrafish gastrulation, Nature 405:76-81 (May 4, 2000).
Hemmati-Brivanlou, A., et al., Follistatin, an Antagonist of Activin, Is Expressed in the Spemann Organizer and Displays Direct Neuralizing Activity, Cell 77:283-295 (Apr. 22, 1994).

Hemmati-Brivanlou, A., et al., Vertebrate Embryonic Cells Will Become Nerve Cells Unless Told Otherwise, Cell 88:13-17 (Jan. 10, 1997).
Hemmati-Brivanlou, A., et al., Inhibition of Activin Receptor Signaling Promotes Neuralization in *Xenopus*, Cell 77:273-281 (Apr. 22, 1994).
Hoppler, S., et al., Expression of a dominant-negative Wnt blocks induction of MyoD in *Xenopus* embryos, Genes & Development 10:2805-2817 (1996).
Hsieh, J.C., et al., A new secreted protein that binds to Wnt proteins and inhibits their activites, Nature 398:431-436 (Apr. 1, 1999).
Itasaki, N., et al., Reprogramming Hox Expression in the Vertebrate Hindbrain: Influence of Paraxial Mesoderm and Rhombomere Transposition, Neuron 18:487-500 (Mar. 1996).
Itoh, K., et al., Graded amounts of *Xenopus* disheveled specify discrete anteroposterior cell fates in prospective ectoderm, Mechanisms of Development 61:113-125 (1997).
Itoh, K., et al., Axis determination by inhibition of Wnt signaling in *Xenopus*, Genes & Development 13:2328-2338 (1999).
Itoh. K., et al., Specific modulation of ectodermal cell fates in *Xenopus* embryos by glycogen syntase kinase, Development 121:3979-3988 (1995).
Jones, CM., et al., An Overview of *Xenopus* Development, Methods in Molecular Biology 97:331-340 (1999).
Jones, C.M., et al., Wholemount In Situ Hybridization to *Xenopus* Embryos, Methods in Molecular Biology 97:635-640 (1999).
Joyner, XL, Engrailed, Wnt and Pax genes regulate midbrain-hindbrain development, Trends in Genetics 12(1):15-20 (1996).
Kintner, C., Molecular bases of early neural development in *Xenopus* embryos, Ann. Rev. Neurosci 15:251-284 (1992).
Kolm, P.J., et al., *Xenopus* Hindbrain Patterning Requires Retinoid Signaling, Developmental Biology 192, 1-16 (1997).
Krieg, PA., et al., In Vitro RNA Synthesis with SP6 RNA Polymerase, Methods in Enzymology 155:397-415 (1988).
Lamb, T.M., et al., Fibroblast growth factor is a direct neural inducer, which combined with noggin generates anterior-posterior neural pattern, Development 121:3827-3636 (1995).
Lee, K.J., et al., The specification of dorsal cell fates in the vertebrate central nervous system, Annual Review of Neuroscience 22(1) 261-294 (1999).
Leyns, L., et al., Frzb-1 is a Secreted Antagonist of Wnt Signaling Expresses in the Spemann Organizer, Cell 88:747-756 (Mar. 21, 1997).
Liem, K.F., et al., A Role for the Roof Plate and Its Resident TGFβ-Related Proteins in Neuronal Patterning in the Dorsal Spinal Cord. Cell 91:127-138 (Oct. 3, 1997).
Liem, K.F., et al., Dorsal Differentiation of Neural Plate Cells Induced by BMP-Mediated Signals from Epidermal Ectoderm, Cell 82:969-979 (Sep. 22, 1995).
Lin, X., et al., Daily cooperates with *Drosophila* Frizzled 2 to transduce Wingless signaling, Nature 400:281-284 (Jul. 15, 1999).
Lu, J., et al., Isolation and characterization of checker β-catenin, Gene 196:201-207 (1997).
Lumsden, A., et al., Patterning the Vertebrate Neuraxis, Science 274:1109-1115 (1996).
McGrew, L.L., et al., Wnt and FGF pathways cooperatively pattern anteroposterior neural ectoderm in *Xenopus*, Mechanisms of Development 69:105-114 (1997).
McGrew, L.L., et al., Specification of the Anteroposterior Neural Axis through Synergistic Interaction of the Wnt Signaling Cascade with noggin and follistatin, Developmental Biology 172:337-342 (1995).
McGrew, L.L.,. et al., Direct regulation of the *Xenopus* engrailed-2 promoter by the Wnt signaling pathway, and a molecular screen for Wnt-responsive genes, confirm a role for Wnt signaling during neural patterning in *Xenopus*, Mechanisms of Development 87:21-32 (1999).
McMahon, A.P., et al., The Midbrain-Hindbrain Phenotype of Wnt-1-/Wnt-1- Mice Results from Stepwise Deletion of engrailed-Expressing Cells by 9.5 Days Postcoitum, Cell 69:581-595 (1992).
Moon, R.T., et al., Structurally Related Receptors and Antagonists Compete for Secreted Wnt Ligands, Cell 88:725-728 (Mar. 21, 1997).

Muhr, J., et al., Convergent Inductive Signals Specify Midbrain, Hindbrain, and Spinal Cord Identity in Gastrula Stage Chick Embryos, Neuron 23:689-702 (Aug. 1999).

Muhr, J., et al., Assignment of Early Caudal Identity to Neural Plate Cells by a Signal from Caudal Paraxial Mesoderm, Neuron 19:487-502 (Sep. 1997).

Munsterberg, A.E., et al., Combinatorial signaling by Sonic hedgehog and Wnt family members induces myogenlc bHLH gene expression in the somite, Genes & Development 9:2911-2922 (1995).

Nieuwkoop, P.D., et al., Activation and organization of the central nervous system in amphibians, The Journal of Experimental Zoology 120(1):1-108 (Jun. 1952).

Pera, E.M., et al., A direct screen for secreted proteins in *Xenopus* embryos identifies distinct activities for the Wnt antagonists Crescent and Frzb-1, Mechanisms of Development 98:183-195 (2000).

Piccolo. S., et al., The head Inducer Cerberus is a multifunctional antagonist of Nodal, BMP and Wnt signals, Nature 397:707-710 (Feb. 25, 1999).

Piccolo, S., et al., Dorsoventral Patterning in *Xenopus*: Inhibition of Ventral Signals by Direct Binding of Chordin to BMP-4, Cell 86:589-598 (Aug. 23, 1996).

Pinson, K.I., et al., An LDL-receptor-related protein mediates Wnt signaling in mice, Nature 407:535-538 (Sep. 28, 2000).

Pownall, M.E., et al., eFGF, Xcad3 and Hox genes form a molecular pathway that establishes the anteroposterlor axis in *Xenopus*, Development 122:3881-3892 (1998).

Pownall, M.E., et al., Two phases of Hox gene regulation during early *Xenopus* development, Current Biology 8(11):673-676 (1998).

Rasmussen, J.T., et al., Regulation of eye development by frizzled signaling in *Xenopus*, Proc Natl Acad Sci USA 98(7):3881-3866 (Mar. 27, 2001).

Rothberg, J.M., et al., slit: an extracellular protein necessary for development of midline glia and commissural axon pathways contains both EGF and LRR domains, Genes & Development 4:2169-2187 (1990).

Ruiz i Altaba, A., Pattern formation in the vertebrate neural plate, TINS 17(6):233-243 (1994).

Salic, A.N., et al., Sizzled: a secreted Xwnt8 antagonist expressed in the ventral marginal zone of *Xenopus* embryos. Development 124:4739-4748 (1997).

Tada, M., et al., Xwnt11 is a target of *Xenopus* Brachyury: regulation of gastrulation movements via Disheveled, but not through the canonical Wnt pathway, Development 127:2227-2238 (2000).

Tamai, K., et al., LDL-receptor-related proteins in Wnt signal transduction, Nature 407:530-535 (Sep. 28, 2000).

Trainor, P., et al., Plasticity in mouse neural crest cells reveals a new patterning role for cranial mesoderm, Nature Cell Biology 2:96-102 (Feb. 2000).

Tsuda, M., et al., The cell-surface proteoglycan Daily regulates Wingless signaling in *Drosophila*, Nature 400:276-280 (Jul. 15, 1999).

Vleminckx, K., et al,. The C-terminal transactivation domain of β-catenin is necessary and sufficient for signaling by the LEF-1/β-catenin complex in *Xenopus laevis*, Mechanisms of development 81:65-74 (1999).

von Heune, G., A new method for predicting signal sequence cleavage sites, Nucleic Acid Research 14:4683-4690 (1986).

Wallingford, J.B., et al., Dishevelled controls cell polarity during *Xenopus* gastrulation, Nature 405:81-85 (May 4, 2000).

Wang, S., et al., Frzb, a Secreted Protein Expressed in the Spemann Organizer, Binds and inhibits Wnt-8, Cell 88:757-766 (Mar. 21, 1997).

Wehrli, M., et al., arrow encodes an LDL-receptor-related protein essential for Wingless signaling, Nature 407:527-530 (Sep. 28, 2000).

Yang, X., et al., CBFA1, OSF-1 Expression and Ex Vivo Mineralisation by Human Osteoprogenitors on 3-Dimensional Porous biodegradable Structures, Poster Session, 47th Annual Meeting, Orthopaedic Research Society, Feb. 25-28, 2001, San Francisco, CA.

Beighton, P., Sclerosteosis, Journal of Medical Genetics 25:200-203 (1988).

Kadkhodayan, S., et al., Cloning, Expression, and One-Step Purification of the Minimal Essential Domain of the Light Chain of Botulinum Neurotoxin Type A. Protein Expression and Purification 19:125-130 (2000).

Laurikkala, J., et al., Identification of a secreted BMP antagonist, ectodin, integrating BMP, FGF, and SHH signals from the tooth enamel knot Developmental Biology 264(1):91-105 (2003).
Marchler-Bauer, A., et al., COD: a curated Entrez database of conserved domain alignments, Nucleic Acids Research 31(1):383-387 (2003).
Stebbins, C.E., et al., Structure of the VHL-ElonginC-ElonginB Comples: Implications for VHL Tumor Suppressor Function, Science Magazine, 284:455-461 (Apr. 16, 1999).
Wood, R.E., et al., Jaw involvement in sclerosteosis: a case report, Dentomaxillofac. Radiol. 17:145-148 (1988).
Balemans, W., et al., Lack of Association Between the SOST Gene and Bone Mineral Density in Perimenopausal Women: Analysis of Five Polymorphisms, Bone, 31(4):515-519 (Oct. 2002).
Ebisawa, T., et al., Characterization of bone morphogenetic protein-6 signaling pathways in osteoblast differentiation, Journal of Cell Science 112:3519-3527 (1999).
Groppe, J., et al., Structural basis of BMP signaling inhibition by the cystine knot protein Noggin, Nature 420:636-642 (Dec. 12, 2002).
Jena, N., et al., BMP7 Null Mutation in Mice: Developmental Defects in Skeleton, Kidney, and Eye, Experimental Cell Research 230:28-37 (1997).
Karsenty, G., et al., Reaching a Genetic and Molecular Understanding of Skeletal Development 2:389-406 (Apr. 2002).
Katagiri, T., et al., Skeletal Abnormalities in Doubly Heterozygous Bmp4 and Bmp7 Mice, Developmental Genetics 22:340-348 (1998).
Patel, KS., et al., Regulation of Bone Formation and Vision by LRP5, The New England Journal of Medicine 346(20):1572-1574 (May 16, 2002).
Solloway, M.J., et al., Mice Lacking Bmp8 Function, Developmental Genetics 22321-339 (1998).
Winkler, D.G., et al., Osteocyte control of bone formation via sclerostin, a novel BMP antagonist, The European Molecular Biology Organization Journal 22(23):6287-6276 (2003).
Kusu, N. et al. Sclerostin is a novel secreted osteoclast-derived bone morphogenetic protein antagonist with unique ligand specificity. J Biol Chem 278, 24113-7 (2003).
Sasai, Y. et al. *Xenopus* chordin: a novel dorsalizing factor activated by organizer-specific homeobox genes. Cell 79,779-90 (1994).
Hsu, D. R., Economides, A. N., Wang, X., Eimon, P. M. & Harland, R. M. The *Xenopus* dorsalizing factor Gremlin identifies a novel family of secreted proteins that antagonize BMP activities. Mol Cell 1,673-83 (1998).
Stanley, E. et al. DAN is a secreted glycoprotein related to *Xenopus* cerberus. Mech Dev 77, 173-84 (1998).
Yokouchi, Y., Vogan, K. J., Pearse, R. V., 2nd & Tabin, C. J. Antagonistic signaling by Caronte, a novel Cerberus-related gene, establishes left-right asymmetric gene expression. Cell 98, 573-83 (1999).
Abreu, J. G., Ketpura, N. I., Reversade, B. & De Robertis, E. M. Connective-tissue growth factor (CTGF) modulates cell signalling by BMP and TGF-beta. Nat Cell Biol. 4, 599-604 (2002).
Fullwood, P. et al. X linked exudative vitreoretinopathy: clinical features and genetic linkage analysis. Br J Ophthalmol. 77, 168-70 (1993).
Aberg, T. et al. Phenotypic changes in dentition of Runx2 homozygote-null mutant mice. J Histochem Cytochem 52, 131-9 (2004).
Karsenty, G. Minireview: transcriptional control of osteoblast differentiation. Endocrinology 142, 2731-3 (2001).
Sevetson, B., Taylor, S. & Pan, Y. Cbfal/RUNX2 directs specific expression of the sclerosteosis gene (SOST). J Biol Chem (2004).
Gall, C., Lauterborn, J. & Guthrie, K. in Autoradiography and Correlative Imaging (ed. W. E. Stumpf and H. F. Solomon) 379-399 (Academic Press, San Diego, 1995).
Kronenberg, H. M. Twist genes regulate runx2 and bone formation. Dev Cell 6,3 17-8 (2004).
Lintern et al., "Characterization of Wise Protein and Its Molecular Mechanism to Interact with both Wnt and BMP Signals," J. Bio. Chem., 284:23159-23168 (2009).
Final Office Action mailed Apr. 27, 2010 in U.S. Appl. No. 11/508,701 (Paper No. 20100422).
Response to Final Office Action mailed Apr. 27, 2010 in U.S. Appl. No. 11/508,701.

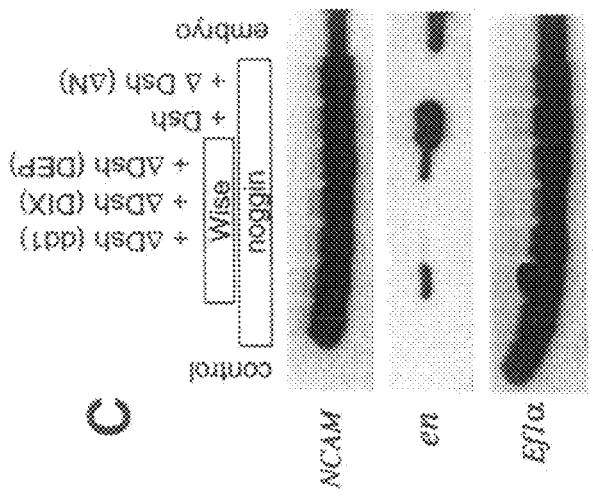
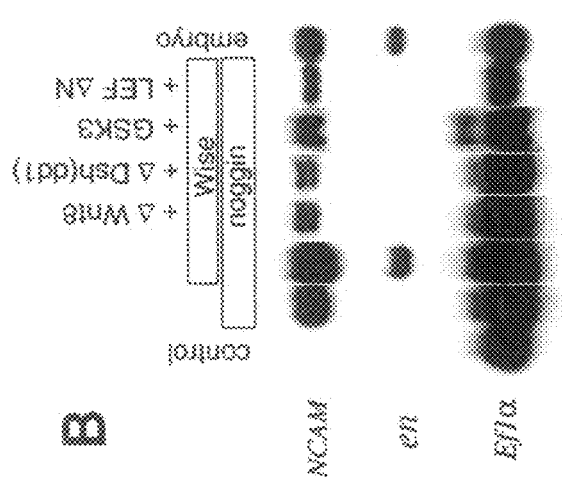
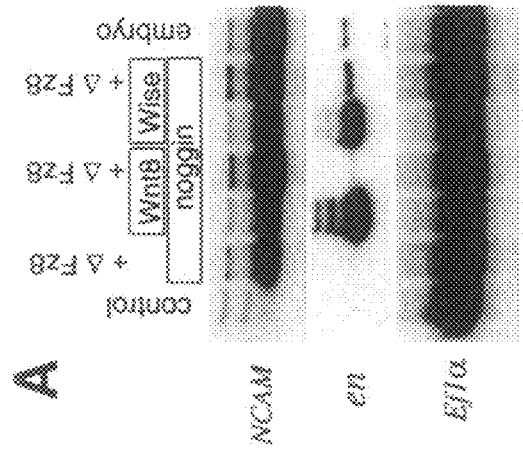
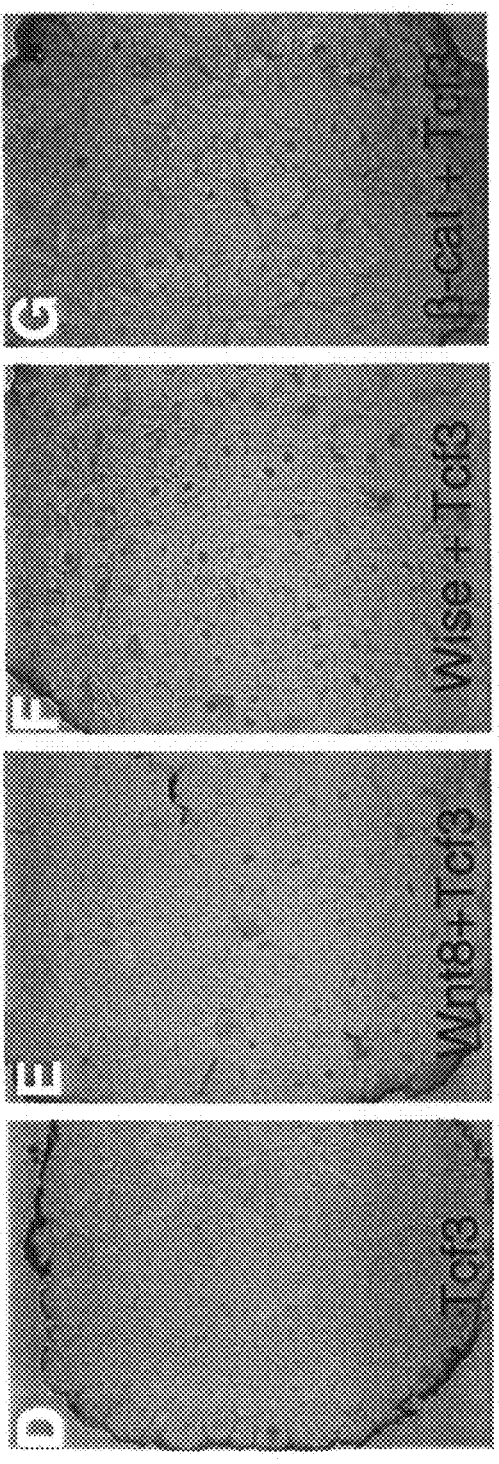
Fig. 6

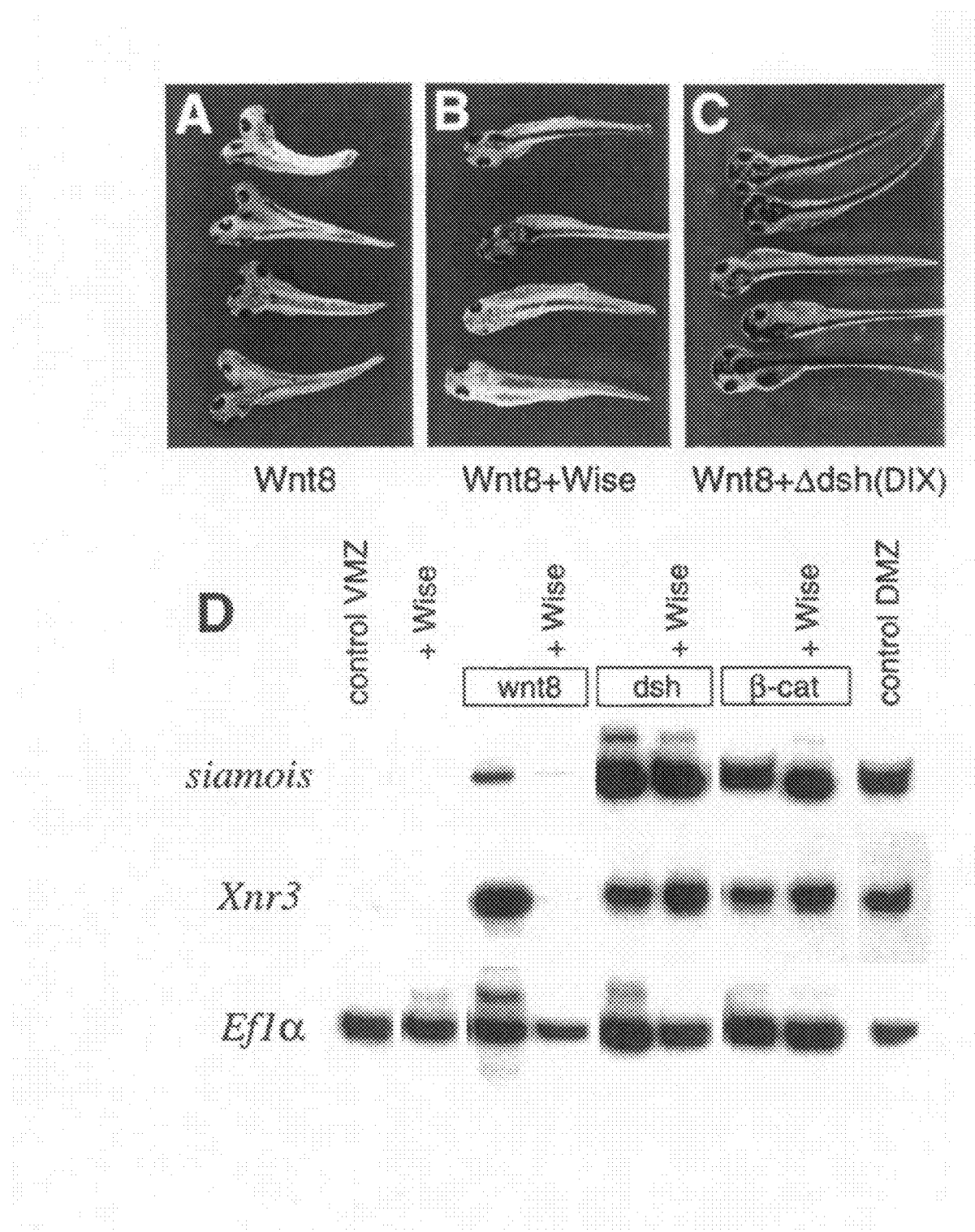
Fig. 7A-D

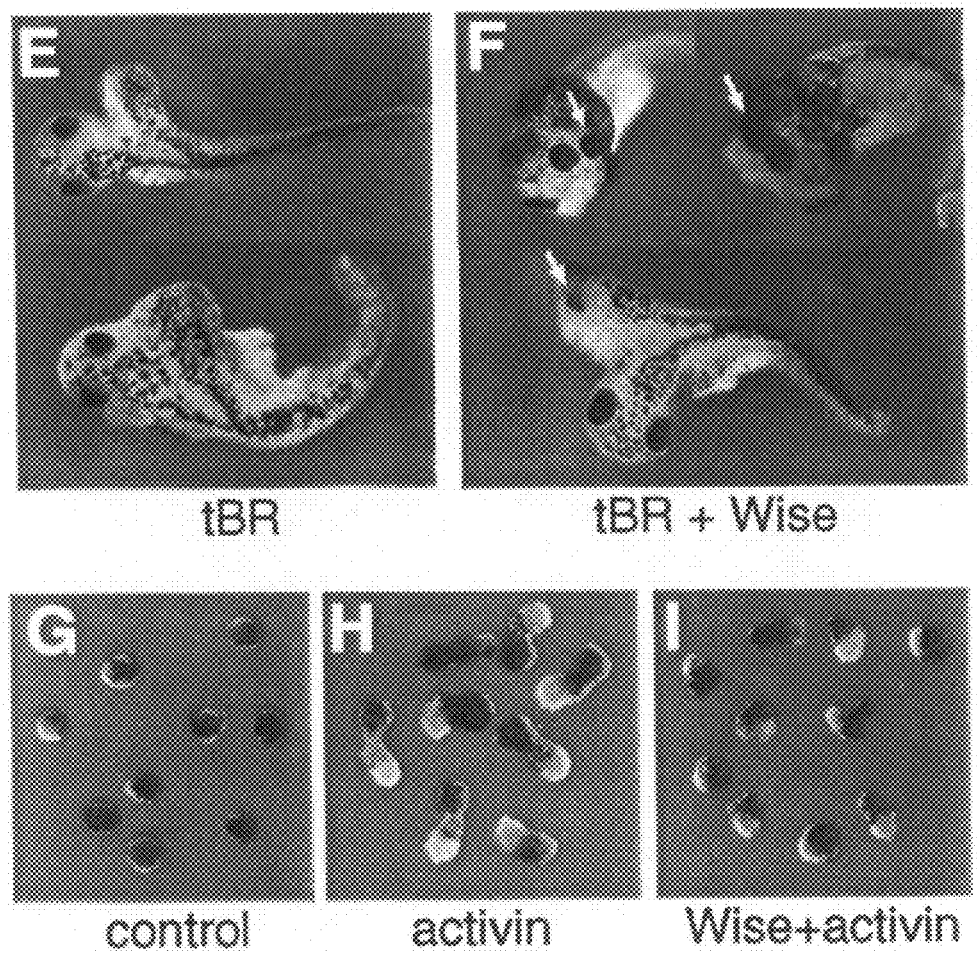
Fig. 7E-I

Fig. 9E

METHOD OF MODULATING SOST BINDING TO LRP

This application is a divisional of U.S. patent application Ser. No. 10/464,368, filed Jun. 16, 2003 now abandoned, which claims benefit to U.S. Provisional Patent Application Ser. No. 60/388,970, filed Jun. 14, 2002.

FIELD OF INVENTION

The present invention relates to Wise and Sost nucleic acid sequences and related amino acid sequences that can be used to influence bone deposition, the Wnt pathway, tooth development, and ocular development. In particular, the present invention also relates to nucleic acid sequences and amino acid sequences that optionally regulate or suppress bone deposition. The present invention relates to a family of nucleic acid molecules which expresses a family of amino acid sequences, some of which are characterized by a cysteine knot, such as the Wise and Sost proteins. The present invention also relates to resultant molecular biology tools derived from Wise or Sost, including plasmids, transfected host cells, antibodies, tranfected host organisms, and knockout organisms. Finally, the present invention relates to the interaction between Wise or Sost and LRP.

BACKGROUND OF INVENTION

To activate and study the Wnt pathway, a wide range of materials and information has been used. Various model organisms explained below are used because of differing developmental characteristics associated with the organisms. Because frogs and mice are exemplary of the organisms of study, they are explained in greater detail below. As will be seen, frogs and mice were used in many of the Examples contained herein. Additionally, various genes and the Wnt pathway are explained.

Background of the Frog.

Frogs, in particular *Xenopus*, are excellent model organisms for testing embryonic development. Two species of *Xenopus* are commonly used for testing, *Xenopus laevis* and *Xenopus tropicalis*. Both *Xenopus* species are natives of Africa. *Xenopus laevis* has been used for many years to investigate the early period of embryonic development. Embryos develop rapidly after fertilization, and a tadpole with a fully functional set of organs forms within a couple of days. Thus, experiments can be conducted on the embryos directly following fertilization. The embryos can develop in a simple saline solution over a few days. The tadpoles are then examined to determine if the experimental intervention had any observable effect. The role of genes in development can be assayed by injecting a tiny amount of any messenger RNA (mRNA) encoding the gene of interest into an early embryo, then once again allowing the embryo to grow into a tadpole.

The *Xenopus* embryo has long served as a major model for the study of embryonic development because of its numerous advantages, including external development, large size, identifiable blastomeres, and its ability to withstand extensive surgical intervention and culture in vitro. These advantages enable extensive investigation of the earliest embryonic patterning events. In fact, much of the current understanding of early embryonic development derives from experiments performed in the *Xenopus* embryo.

More particular to the frog, the earliest events of all animal embryos are controlled by mRNAs that are deposited in the egg by the mother. These maternal mRNAs control embryonic processes that occur prior to the transcription of the embryonic genome. These processes can best be examined in *Xenopus* because, in these embryos, they occur during an especially long period of time, and because they occur while the embryo is developing externally. Such features have resulted in a detailed cellular and molecular understanding of early patterning events, including a comprehensive view of the role of specific extracellular growth factors, cell surface receptors, and intracellular signaling pathway components. These events include the patterning of the basic body plan, the determination of cell fate, and the early patterning of major organs, including the digestive system, circulatory system, and nervous system. In addition, many of the factors originally identified in *Xenopus* have been subsequently shown to control numerous later developmental events, as well as other critical biological processes, and oncogenesis. Finally, *Xenopus* is a major contributor to understanding cell biological and biochemical processes, including chromosome replication; chromatin, cytoskeleton, and nuclear assembly; cell cycle progression; and, intracellular signaling. Thus, *Xenopus* is ideally suited for studying early embryonic patterning and cell fate determination, later development, and organogenesis, oncogenesis, and cell biological and biochemical processes.

Background of A-P Patterning.

The mechanisms that generate regional differences along the anterior posterior (A-P) axis of the vertebrate nervous system play an important role in pattern formation during development. The classical activation/transformation model proposed by Nieuwkoop suggests that an initial signal induces neural tissue of anterior type and then a second transforming signal differentially acts on it to convert cells to a more posterior character (Nieuwkoop, 1952; Slack and Tannahill, 1992). This transformer or "posteriorizing factor(s)" thus modifies a ground state to generate the full spectrum of neural structures along the A-P axis. However, patterning of the anterior region is clearly more complicated than a simple default state of neural induction. This is highlighted by the presence of local inductive centers, such as the anterior visceral endoderm and the isthmus, which are essential for anterior neural development. Hence, models for a coordinated mechanism of A-P patterning in the nervous system need to integrate the influence of local signals on rostral brain patterning, with the influence of posteriorizing factors that work more generally on the hindbrain and spinal cord.

Analysis of posteriorizing signals in neural patterning is complicated by the tissue interactions and dynamic morphogenetic movements which occur during gastrulation. *Xenopus* animal caps provide a simplified system for studying patterning events separately from morphogenetic movements. Animal caps alone form epidermis in culture, but when treated with antagonists of Bone Morphogenic Protein (BMP) signaling, such as Noggin, Chordin, Follistatin, or truncated BMP receptors, they adopt an anterior neural fate. Using these molecules as neural inducers, experimental studies in animal caps have provided evidence that fibroblast growth factor (FGF), retinoic acid (RA), and Wnt (Wingless and iNT-1) signaling pathways influence A-P patterning by inducing posterior characters. Wnt is also known as the canonical Wnt pathway and the Wnt planar polarity pathway. Thus, *Xenopus* embryo assays and experiments in other vertebrates provide more evidence that RA, FGF, and Wnt pathways influence A-P patterning. It is desired to better understand the relative roles of these biochemical cascades, the degree to which they are used at any particular axial level, and how they are integrated in organizing normal A-P patterning.

Mesoderm plays an important early role in A-P patterning of neural tissue. Mesoderm is the middle layer of embryonic cells between the ectoderm and endoderm in triploblastic animals, and forms muscle, connective tissue, blood, lymphoid tissue, the linings of all the body cavities, the serosa of the viscera, the mesenteries, and the epithelia of the blood vessels, lymphatics, kidney, ureter, gonads, genital ducts, and suprarenal cortex. Experiments in *Xenopus* have shown that planar signals within the neuroectoderm and vertical signals from the underlying mesoderm work in concert to control regional identity of the nervous system. While early A-P specification of the nervous system occurs during gastrulation, it is not irreversibly committed to a particular identity. Grafting experiments in several species reveal plasticity in regional character and show that mesoderm is still playing a role at later stages. For example, analysis of the Hoxb4 gene has shown that its expression pattern is established through interactive signaling between the neural tube and the surrounding mesoderm. Furthermore, somites and paraxial mesoderm are sufficient to re-program Hox expression in the neural tube to a more posterior character when grafted ectopically. The ability of mesoderm to regulate regional character from early gastrula stages and to program motor neuron subtype identities further emphasizes the importance of mesoderm and its signaling in patterning the developing nervous system.

The study of A-P patterning and focus on the mesoderm is of particular importance in the present invention because such patterning impacts bone development in an embryo. Pathways which control A-P patterning often impact bone development.

As such, it is desired to better understand the process of posteriorization. The identification of new factors that can modulate existing pathways, such as Wnts, FGF, and RA, or which represent novel signaling inputs will be beneficial to understanding how A-P patterning is coordinated. In particular, it is desired to understand how the Wnt pathway is activated and controlled. *Xenopus* has been used to study A-P patterning, that, in turn, is apparently impacted by the Wnt pathway. *Xenopus* can also be used to study activators or inhibitors of the Wnt pathway.

Background of Mouse Model.

Mice are also excellent model organisms for testing embryonic development. Mice and humans possess similar genes, mice show many clinical symptoms of human disease, and powerful techniques are available for genetic alterations of the mouse genome. All of these factors make mice excellent experimental models for testing new therapies. Mice share many fundamental biological processes with humans therefore, mice are considered to be one of the most significant laboratory models for human disease and genetic mutations. Research regarding human biological processes and genetic diseases can be greatly enhanced by studying the mouse model for similar biological processes and diseases.

Mice have been a preferred experimental model for a number of years due to their small size, short life span, and the female's ability to produce a litter within two months after her birth. These factors allow researchers to follow a given disease process from beginning to end within a short time frame. For these various reasons, mouse models are preferred for testing new drug therapies, designing novel therapies, and studying genetic diseases potentially also affecting humans.

Genes can be inserted into a fertilized mouse egg by several methods including physical injection. The gene is first attached to a promoter and then is injected into the fertilized egg. The fertilized egg is implanted into a female mouse and the embryo is allowed to develop to a specified given stage for study. Once embryos reach the desired stage of development, they can be harvested and tested to determine experimental results. Alternatively, embryos can be allowed to develop into full-term pups prior to being harvested to determine the results of the experiment.

Because mice are phylogenetically closely related to humans with regards to biological processes and diseases, and because of the rapidity of mouse embryological development, they are considered to be an excellent animal model for the study of human development, biological processes, and disease.

Background of Wnt.

Wnt proteins form a family of highly conserved secreted signaling molecules that regulate cell-to-cell interactions during embryogenesis. Wnt genes and Wnt signaling are also implicated in aberrant cancer cell regulation. Insights into the mechanisms of Wnt action have emerged from several systems: genetics in *Drosophila* and *Caenorhabditis elegans* (*C. elegans*); and, biochemistry in cell culture and ectopic gene expression in *Xenopus* embryos. Many Wnt genes in the mouse have been mutated, leading to very specific developmental defects. As currently understood, Wnt proteins bind to receptors of the Frizzled family on the cell surface. Through several cytoplasmic relay components, the signal is transduced to β-catenin, which then enters the nucleus and forms a complex with TCF or LEF to activate transcription of Wnt target genes. The extracellular Wnt ligand binds the transmembrane receptor Frizzled (Fz), which activates the cytoplasmic phosphoprotein Dishevelled (Dsh). Activated Dsh inhibits GSK3 β-mediated degradation of β-catenin. β-catenin protein, therefore, accumulates and, in association with transcription factors (TCF-3, TCF-4, LEF), regulates gene transcription in the cell nucleus.

Wnt-proteins, secreted glycoproteins, serve as important signaling molecules during development of invertebrates and vertebrates. They have been shown to play crucial roles in such diverse processes as cancer, organogenesis, and pattern formation. To date, 19 Wnt genes have been isolated in higher vertebrates, 7 have been found in the genome of *Drosophila*, and 5 in the *C. elegans* genome. Wnt genes are defined by their sequence similarity to the founding members, Wnt-1 in the mouse (originally called iNT-1) and wingless (Wg) in *Drosophila*. The genetic analysis of the Wg signaling pathway in *Drosophila* has led to the identification of many downstream components, which have been shown to be functionally conserved in other organisms. Wg/Wnt-proteins are thought to signal through seven-transmembrane receptors encoded by the Frizzled (Fz) gene family to regulate the stability of an effector protein known as armadillo (Arm) in flies or β-catenin (β-cat) in vertebrates, which eventually leads to the activation of target genes through a complex of Arm/β-cat, with DNA-binding transcription factors of the TCF/LEF family. This pathway is referred to as the canonical Wnt-pathway.

In recent years, evidence has been provided that Wnt signaling in the chick is involved in a variety of processes associated with skeletogenesis, such as chondrogenesis and joint development. Previously, it has been shown that there are at least three Wnt genes, Wnt-4, Wnt-5a, and Wnt-5b, as well as components of the canonical Wnt signaling pathway, expressed in chondrogenic regions, and that there is a fourth Wnt gene, Wnt-14, which is expressed early in the joint forming region (FIG. 1D). Wnt-4 is also expressed in regions of the joint, however, its expression is restricted to cells in the periphery of the joint interzone (FIG. 1C). Wnt-5a expression is restricted to cells in a region of the perichondrium which will develop into the periosteum (FIG. 1A), while the closely related Wnt-5b gene is expressed in a sub-population of prehypertrophic chondrocytes, as well as cells of the outer layer of the perichondrium (FIG. 1B).

Much of what is known about the functional role of Wnt signaling in early vertebrate development comes from experiments with *Xenopus*. Maternally encoded components of the canonical Wnt signaling pathway function to establish the endogenous dorsal axis. The sperm fertilizing the egg triggers cortical rotation. Vesicles are moved towards the future dorsal side. A dorsal determinant, which is likely to be Dishevelled, is transported with these vesicles. Dishevelled accumulates on the dorsal side and inhibits GSK3. β-catenin can therefore accumulate on the dorsal side and, together with XTCF-3, induce the expression of siamois, which regulates downstream dorsal development.

As such, the Wnt signaling system is one of only a limited number of signaling systems used during embryonic development to pattern the ultimate resultant morphological physical body construction plan. Clearly, Wnt signaling is triggered at several discrete time points during development, both at different developmental stages and within different tissues (see Table below).

TABLE 1

| Gene | Expression | Function |
| --- | --- | --- |
| XWnt-1 | anterior neural | mid-/hindbrain boundary |
| XWnt-2 (=XWnt-2B) | neural and heart | not known |
| XWnt-3-A | posterior neural | neural anteroposterior patterning |
| XWnt-4 | neural, kidney (pronephros) | kidney morphogenesis |
| XWnt-5A | ectoderm | not known |
| XWnt-8 | ventral mesoderm | mesodermal patterning |
| XWnt-8b | forebrain | not known |
| XWnt-11 | dorsal marginal zone | gastrulation movements |

Early *Xenopus* development provides an excellent model system for studying the general questions of tissue-specific response to Wnt signaling. Before the onset of zygotic transcription at the Mid-Blastula Transition (MBT) phase, the Wnt pathway functions to establish the dorsal body axis. Only an hour or two later, after MBT, XWnt-8 functions to promote ventral and lateral mesoderm. These strict stage-specific responses to Wnt signaling could conceivably be induced by differential use of the canonical and alternative Wnt signal transduction pathways.

It is further known to those of skill in the art that Wnt genes are active in osteoblast cells. Wnt regulates bone deposition in embryos and in mature individuals. It has been found that Wnt signals impact the dorsal-ventral pattern in early *Xenopus* embryo. In late embryos, Wnt causes anterior-posterior patterning of the neural tissue, neural crest formation, and organogenesis. As such, it is desired to have compositions and methods for controlling Wnt signaling. Such compositions and methods would have impact on embryonic developmental processes such as anterior-posterior patterning and on bone deposition.

Background of Sost.

Sost is believed to be a Bone Morphogenic Protein (BMP) antagonist. Mutations in the human Sost gene on human chromosome 17 can result in sclerosteosis, which is an autosomal recessive sclerosing bone dysplasia characterized by progressive skeletal overgrowth. A high incidence of the bone dysplasia disorder, occurring as a result of a founder effect in affected individuals has been reported in the Afrikaner population of South Africa, where a majority of individuals are affected by the disorder. Homozygosity mapping in Afrikaner families, along with analysis of historical recombinants, localized sclerosteosis to an interval of ~2 cm. between the loci D17S1787 and D17S930 on chromosome 17q12-q21. Affected Afrikaners carry a nonsense mutation near the amino terminus of the encoded protein, whereas an unrelated affected person of Senegalese origin carries a splicing mutation within the single intron of the gene. The Sost gene encodes a protein that shares structural and functional similarity with a class of cysteine knot-containing factors, including dan, cerberus, gremlin, and caronte. The specific and progressive effect on bone formation observed in individuals affected with sclerosteosis suggests that the Sost gene encodes a regulator of bone homeostasis.

As such, evidence is provided herein that the deficiency of the Sost gene product, a novel secreted protein expressed in osteoblasts, leads to the increased bone density in sclerosteosis. The two nonsense mutations, and the splice site mutation, are loss-of-function mutations. Previously, the precise function and working of Sost was believed unknown, an inhibitory effect on bone formation can be proposed since pathophysiological analysis indicated that sclerosteosis is primarily a disorder of increased formation of normal bone. While it is known that Sost impacts bone formation, it is desired herein to better delineate the mechanism of action and pathway of Sost's bone deposition activity. Previously, it has been hypothesized that Sost affected BMP rather than the Wnt pathway. Previous to our described invention herein, it was not known that Sost reacted with Wnt pathway elements. The Sost-Wnt pathway interaction can be alternatively direct or indirect in nature.

Background of LRP6.

LRP genes encode the low-density lipoprotein (LDL)-receptor-related proteins, LRP5 and LRP6. Human LRP5 and LRP6 share 71% amino-acid identity, and together with Arrow, form a distinct subgroup of the LRP family. Arrow, LRP5, and LRP6 each contain an extracellular domain with epidermal growth factor (EGF) repeats and low-density lipoprotein receptor (LDLR) repeats, followed by a transmembrane region and a cytoplasmic domain lacking recognizable catalytic motifs. An LRP6 mutation in mice results in pleiotropic defects recapitulating some, but not all, of the Wnt mutant phenotype. LRP5/LRP6 involvement in Wnt signaling and LRP function in Wnt-induced axis *Xenopus* embryos have been previously studied.

LRPs and Arrow in *Drosophila* are long single-pass transmembrane proteins. These proteins are of interest because they interact with and affect Wnt signaling. Arrow is genetically required for Wingless (Wg) signaling (Wehril, 2000) and mouse LRP mutations are similar in phenotype to Wnt mutants (Pinson, 2000). In *Xenopus*, over-expression of LRP can activate Wnt signaling (Tamai, 2000). There is evidence that Wnts can bind directly to the extra-cellular domain of LRP and form a ternary complex with the Frizzled receptor (Tamai, 2000). Also, the cytoplasmic domain of LRP can interact with Axin (Mao, 2001). Thus, LRP/Arrow appear to be important to understanding Wnt.

As stated, the Frizzled (Fz) family of serpentine receptors function as Wnt receptors, but how Fz proteins transduce signaling is not understood. In *Drosophila*, Arrow phenocopies the Wingless (DWnt-1) phenotype, and encodes a transmembrane protein that is homologous to two members of the mammalian low-density lipoprotein receptor (LDLR)-related protein (LRP) family, LRP5 and LRP6. It is reported that LRP6 functions as a co-receptor for Wnt signal transduction. In *Xenopus* embryos, LRP6 activated Wnt-Fz signaling, and induced Wnt responsive genes, dorsal axis duplication, and neural crest formation. An LRP6 mutant lacking the carboxyl intracellular domain blocked signaling by Wnt or Wnt-Fz, but not by Dishevelled or β-catenin, and inhibited neural crest development. The extracellular domain of LRP6 bound Wnt-1 and associated with Fz in a Wnt-dependent manner. This indicates that LRP6 is likely to be a component of the Wnt receptor complex.

Further, Wnt/β-catenin signaling induces dorsal axis formation through activation of immediate, early responsive genes, including nodal-related 3 (Xnr3) and Siamois (Sia). It has been shown that in two developmental processes dependent on the Wnt pathway in *Xenopus*—secondary axis and neural crest formation—LRP6 activates, but a dominant-negative LRP6 inhibits, Wnt signaling, providing compelling evidence that LRP6 is critical in Wnt signal transduction. LRP6 functions upstream of Dsh in Wnt-responding cells, synergizes with either Wnt or Fz, and importantly, is able to bind Wnt-1 and to associate with Fz in a Wnt-dependent manner. The simplest interpretation of these findings is that LRP6 is a component of the Wnt-Fz receptor complex.

Genetic studies of Arrow in *Drosophila* and LRP6 in mice strongly support this hypothesis. Data also indicates the possibility that Wnt-induced formation of the Fz-LRP6 complex assembles LRP6, Fz and their associated proteins, thereby initiating cytoplasmic signaling. Consistent with this notion, Wnt signal transduction requires intracellular regions of both Fz and LRP6, which harbor candidate protein-protein interaction motifs. Notably, Arrow does not exhibit Fz planar polarity phenotype, implying that Arrow-LRP6 may specify Wnt-Fz signaling towards the β-catenin pathway. How Fz, LRP6, and proteoglycan molecules, such as Dally, interact to mediate Wnt recognition/specificity, and signal transduction remains to be elucidated. Thus, it is understood that LRP interacts with Wnt. The present invention is designed and characterized to control LRP binding to Wnt and Fz, and, more particularly, to control LRP upstream.

Background of LRP5.

In humans, low peak bone mass is a recognized significant risk factor for osteoporosis. It has been reported that LRP5, encoding the LDLR-related protein 5, affects bone mass accrual during growth. Mutations in LRP5 cause the autosomal recessive disorder osteoporosis-pseudoglioma syndrome (OPPG). OPPG is an autosomal recessive disease, characterized by severe osteoporosis due to decreased bone formation and pseudoglioma resulting from failed regression of primary vitreal vasculature. Y. Gong, et al. (2001). Gain of gene function leads to high bone mass (HBM) phenotype as an autosomal dominant trait, whereas loss of function leads to osteoporosis.

It has been found that OPPG carriers have reduced bone mass when compared to age- and gender-matched controls. LRP5 expression by osteoblasts in situ has been demonstrated and LRP-5 has been shown to reduce bone thickness in mouse calvarial explant cultures. These data indicate that Wnt-mediated signaling via LRP5 affects bone accrual during growth and is important for the establishment of peak bone mass.

In mice, it has been found that LRP5 participates in bone formation and bone mass. Null mutation of LRP5 causes post-natal bone loss, resulting from decreased bone formation and osteoblast proliferation, independent of Runx2. M. Kato, et al. (2002). In contrast, transgenic mice expressing LRP5 with the HBM mutation G171V exhibit increased bone formation and bone mass, without skeletal developmental abnormalities. F. Bex, et al. (2002).

LRP5 appears to interact with the Wnt pathway since LRP5 with the HBM mutation prevents inhibition of Wnt signaling by Dikkopf-1. L. M. Boyden (2002); A. M. Zorn (2001). There is murine hybridization and microarray evidence that indicates Wnt signaling is involved in bone fracture repair. M. Hadjiargyrou (2002). Six additional mutations in LRP5, located in the amino-terminal domain near G171, have been identified. These mutations cause increased bone density, particularly in cortical bone. L. Van Wesenbeeck (2003).

Background of β-catenin.

β-catenin reports demonstrate its accumulation opposite the sperm entry point by the end of the first cell cycle. β-catenin continues to accumulate in dorsal (i.e., opposite the sperm entry point) but not ventral cytoplasm through the early cleavage stages. By the 16- to 32-cell stages, it accumulates in dorsal but not ventral nuclei. Remarkably, the pattern of dorsal accumulation of β-catenin closely parallels the ability of transplanted dorsal cells to induce an axis when implanted into host embryos. Thus, β-catenin is the first signaling molecule to show a dorso-ventral polarity in the early embryo. Combined with the loss-of-function data from Heasman et al., it is now clear that when fertilization elicits a cortical rotation, and displacement of material and organelles to the future dorsal side, it leads to a dorso-ventral asymmetry in β-catenin, which is required for axis formation.

Brannon et al. show that the HMG Box factor XTCF-3 directly binds the siamois promoter. In the absence of β-catenin, XTCF-3 inhibits gene expression. However, on the dorsal side of the embryo, β-catenin binds the XTCF-3, and, thus, activates the gene. This is notable because siamois is a homeobox gene likely playing a major role in specifying formation of Spemann's Organizer. Therefore, a dorso-ventral difference in β-catenin forms within an hour or two of fertilization, directly regulating a key homeobox gene in the blastula, thus contributing to formation of Spemann's Organizer on the dorsal side of the gastrula.

β-catenin not only impacts development, but it influences bone development in adults. Regulation of osteoblasts results from accumulation of β-catenin in the cell. It is desired to have methods and compositions for controlling bone deposition. It is known that the Wnt pathway controls accumulation of β-catenin, which regulates osteoblast expression. It is desired to control and inhibit osteoblast regulation by preventing Wnt pathway activation. For this reason, the present invention includes nucleic acid molecules and amino acid sequences for controlling Wnt.

SUMMARY OF INVENTION

The present invention relates to Wise nucleic acid sequences and amino acid sequences, Sost nucleic acid sequences and amino acid sequences, and LRP nucleic acid sequences and amino acid sequences. Additionally, the present invention relates to control over the influencing of bone deposition, ocular development, tooth development, and the Wnt pathway using the above nucleic acid sequences and amino sequences. Additionally, the present invention relates to molecular tools developed from the nucleic acids and polypeptides including vectors, transfected host cells, transfected organisms, knockout organisms, antibodies, hybridomas cells, Fab fragments, and homologous nucleic acid sequences and polypeptides. Mutants of the Wise, Sost, and LRP nucleic acid sequences and polypeptides are contemplated herein and are used to influence the pathways. The Wise and Sost nucleic acid sequences are generally about 70% homologous. Related to this are cysteine knot polypeptides which bind to LRPs as well as a variety of polypeptides. There is a family of nucleic acid sequences and polypeptides expressed therefrom, which are related to the Wise and Sost sequences. The host cells that can be treated with the mutants of the present invention include insects, amphibian, and mammalian cells.

Nucleic acid sequences, and the resultant polypeptides, are members of a family of isolated nucleic acid molecules which influence one of the following: tooth development, WWnt pathway activation, bone deposition, or ocular development is contemplated herein. The family includes a variety of nucleic acid molecules including NDP, DAN, Caronte, PDGF, Wise, Sost, Cereberus, Gremlin, CTGF, Soggy, DKK1, Cyr61, DKK2, DKK3, DKK4, NOV, Mucin, Slit, OOH, Wisp, and CCN. Related to this are the LRP family of molecules which also influence these various pathways. In particular, LRP 1, 2, 5, and 6. As such, the family that expresses a cysteine knot polypeptide binds to one of the LRPs. The various nucleic acids are specifically listed in the Sequence ID listing included herewith. Related to this are degenerate variants of the nucleic acid molecules. As mentioned, the family of nucleic acid molecules typically expresses a polypeptide that includes a cysteine knot protein, with the cysteine knot protein including eight cysteine residues. However, variations of the cysteine knot protein are available for use. As such, any nucleic acid sequence which impacts the previously mentioned pathways and expresses a cysteine knot protein is believed related to the present family of nucleic acid sequences. It is known that Exon 2 of the Wise nucleic acid sequence (SEQ. ID. NO. 128) expresses a desired cysteine knot protein. As such, oligonucleotide fragments which are 70% homologous to Wise Exon 2 are believed to be potentially related to the present family of nucleic acid molecules.

Mutant versions of the above nucleic acid molecules can result in increased bone deposition, as well as tooth development and ocular development. Additionally, the mutants will influence with Wnt pathway activation. As such, mutant versions of the nucleic acid molecules of the present invention are known to impact the mentioned pathways in a variety of ways. The present invention resultingly relates to any mutant version of the listed nucleic acid sequences. The mutants can be generated via point, frame shift, deletion, or loss of function mutations. Loss of function mutations can be achieved by placing a stop codon near the beginning of the selected nucleic acid sequences, which would include before or after the start of the sequence. For example, a stop codon can be placed just after the start of Exon 1 of the Wise nucleic acid sequence. During translation the stop codon will prevent translation of the Wise Exons and therefore the polypeptide will not be expressed. Other available mutants include antisense RNAs, morpholinos, antisense oligonucleotides, mRNAs translated from the selected nucleic acid sequences, and RNAi complementary to the nucleic acids sequences.

As discussed herein, nucleic acid sequences and nucleic acid molecules will be used interchangeably. The isolated nucleic acid sequences include gDNAs, cDNAs, and a variety of other nucleic acid sequence fragments. It is contemplated that any of a variety of nucleic acid sequences can be used herein including genes, mRNA, cDNA, gDNA, tRNA, oligonucleotides, polynucleotides, and nucleic acid sequence fragments. As such, any nucleic acid sequence which expresses a polypeptide that influences either tooth development, Wnt pathway activation, bone deposition, or ocular development is contemplated as part of the present invention, as well as mutant versions thereof. The nucleic acid sequences will include genes which are any hereditary unit that has an affect on the phenotype of an organism and can be transcribed into mRNAs which result in polypeptides, as well as rRNAs or tRNA molecules and regulatory genes. Also, alleles and mutant alleles are part of the definition of a gene as used herein.

Probes which hybridize to either mutant nucleic acid sequences or the non-mutant nucleic acid sequences are part of the present invention. The probes will include any of a variety of labels and can be either cDNA or RNA probes. The probes can be used to form a kit or similar tool for use in detecting the presence or absence of a particular Wise, Sost, or LRP nucleic acid or polypeptide.

Vectors are formed from both the isolated nucleic acid sequences and the mutant versions of the isolated nucleic acid sequences. The vectors include expression, cloning, and viral vectors. Other available vectors include fusion vectors, gene therapy vectors, two-hybrid vectors, reverse two-hybrid vectors, sequencing vectors, and cloning vectors. Also, prokaryotic and eukaryotic vectors may be used. Specific prokaryotic vectors that may be used in the present invention include pET, pET28, pcDNA3.1/V5-His-TOPO, pCS2+, pcDNA II, pSL301, pSE280, pSE380, pSE420, pTrcHis, pRSET, pGEMEX-1, pGEMEX-2, pTrc99A, pKK223-3, pGEX, pEZZ18, pRIT2T, pMC1871, pKK233-2, pKK38801, and pProEx-HT. Specific eukaryotic vectors that may be used herein include pFastBac, pFastBac HT, pFastBac DUAL, pSFV, pTet-Splice, pEUK-C1, pPUR, pMAM, pMAMneo, pBI101, pBI121, pDR2, pCMVEBNA, YACneo, pSVK3, pSVL, pMSG, pCH110, pKK232-8, p3'SS, pBlueBacIII, pCDM8, pcDNA1, pZeoSV, pcDNA3, pREP4, pCEP4, and pEBVHis. As mentioned, a variety of promoters may be used with the vector, as well as any of a variety of selectable markers. Available markers include antibiotic resistance genes, a tRNA gene, auxotrophic genes, toxic genes, phenotypic markers, colorimetric markers, antisense oligonucleotides, restriction endonuclease, enzyme cleavage sites, protein binding sites, and immunoglobulin binding sites. Specific selectable markers available include LacZ, neo, Fc, DIG, Myc, and FLAG.

Any of a variety of host cells, including prokaryotic and eukaryotic cells, can be transfected with the vectors previously mentioned. Prokaryotic host cells include Gram-negative and Gram-positive bacteriums may be transfected with any of the variety of the vectors previously mentioned. Available bacteriums include *Escherichia, Salmonella, Proteus, Clostridium, Klebsiella, Bacillus, Streptomyces,* and *Pseudomonas*. A preferred Gram-negative bacterium is *Escherichia coli*. Eukaryotic vectors can be used to transfect eukaryotic host cells including yeast, plant, fish, mammalian, human, mouse, frog, or insect cells. Specific host cells that can be transfected include ES, COS, HEK 293, CHO, SaOS, osteosarcomas, KS483, MG-63, primary osteoblasts, osteoclasts, chrondocytes, and human or mammalian bone marrow stroma. As such, the present invention includes host cells transfected with any of the previously mentioned vectors.

It is specifically contemplated that mutant Wise nucleic acid sequences can be used. The mutant Wise nucleic acid sequences will be mutated versions of SEQ. ID. NO. 1-5, 126-128, 109, 96, and 97, as well as complementary mutant sequences thereof. Additionally, degenerate variants of these sequences may also be used. Plasmids can be formed from these mutant Wise nucleic acid sequences, as well as transfected host cells. Additionally, mutant organisms can be formed from the mutant Wise nucleic acid sequences, including Wise mutant mice. Sost and LRP can also be mutantized and various related constructs can be formed therefrom. Specific mutants to either Wise, Sost, or LRP can be developed related to SEQ. ID. NO. 1-44, 96-103, 108, 110-113 and 126-128 listed herein.

Amino acid sequences which influence at least one of the following, tooth development, Wnt pathway activation, bone deposition, or ocular development are part of the present invention. Available amino acid sequences include those polypeptides or proteins expressed from the previously discussed nucleic acid molecules. In particular, Wise, Sost, and LRP polypeptides and amino acid sequences can be used herewith. Specifically available amino acid sequences include those listed in the SEQ. ID. NO. 45-95, 104-107, 109, 114-125. Isolated polypeptides that have a cysteine knot formed from eight cysteine knot residues which impact the previously listed pathways are included herewith. Finally, amino acid sequences which are 70% homologous to Exon 2 polypeptides of Wise may be used herewith. When used herein amino acid sequences include any of a variety of polypeptide and protein molecules.

Antibodies which bind to at least one of the previously mentioned amino acid sequences are used herewith. The antibodies include monoclonal, polyclonal, recombinant, and antibody fragments. Any of a variety of antibodies may be used that bind to either Wise, Sost, or LRP 1, 2, 5, or 6. The antibodies are designed to either bind to the selected polypeptide and prevent it from binding to its normal antigen. Conversely, the antibodies can be designed such that they attack and destroy the chosen or selected polypeptides. For example, it is preferred to bind either Wise or Sost with Wise or Sost antibody, respectively, whereby Wise or Sost is prevented from binding to LRP 5 or 6. As such, it is desired to have antibodies that specifically bind Wise, Sost, or LRP. Related to the antibodies are Fab fragments which function the same way as the chosen antibodies. These anti-peptide antibodies will prevent binding by the selected amino acid sequence to an LRP for example. The antibodies can be directed to both mutant and non-mutant versions of polypeptides expressed from the mutant or non-mutant versions of the nucleic acid sequences.

Hybridomas can be formed which are used to produce the desired antibodies. As such any of a variety of cells can be used to produce both the polypeptides as well as the antibodies.

It is known that both Wise and Sost polypeptides bind to LRP 5 or 6 polypeptides. As such, the present invention relates to a protein molecule formed from a Wise polypeptide bound to an LRP polypeptide. Additionally, the present invention relates to a Sost polypeptide bound to an LRP polypeptide.

Use of the isolated nucleic acid sequences or polypeptides can specifically result in increased bone deposition, both in vivo and in vitro. As such a variety of methods can be practiced which are designed to increase the bone deposition either in a selected cell or a selected host organism. One particular method includes isolating a nucleic acid sequence which can be either Wise, Sost, or LRP. The nucleic acid sequence then is used to form a cassette which includes a stop codon at the beginning of the nucleic acid sequence. Preferably, the cassette will include a marker and a promoter. The selected nucleic acid sequence can be either a mutant or a non-mutant nucleic acid sequence, with the sequence selected dependent upon the desired outcome. The cassette is then used to form a plasmid whereby any of a variety of plasmids, as previously mentioned, may be used. Once the plasmid is formed it is used to transfect a host cell. Any of a variety of methods can be used to transfect a host cell including microinjection. The available host cell will include a variety of prokaryotic and eukaryotic cells. Among the available cells are embryonic stem cells, blastomeres, and a variety of other stem cells. Once the host cell is transfected the stop codon can be activated to cause a loss of function mutation which results in a phenotypic change. Among the phenotypic changes are increased bone deposition. The transfected host cells can also be used to transfect a host cell organism such as a mouse. The cells are injected into an embryo with the embryo then allowed to develop or mature. Host cells include insect, amphibian, and non-human mammal. Human cells can also be treated in vitro. Specific delivery of the nucleic acid sequence into the host cell can be accomplished via microinjection, micro-vessel encapsulation, liposome encapsulation, and electroporation. Desired host cells include osteoblasts, osteoclasts, and chrondocytes. Besides attaching stop codons to the nucleic acid sequence in the plasmid, other mutantized versions may be used. In particular, an alternative to the stop codon are point mutations, frame shift mutations, and other mutations may be used to preclude accurate translation of the polypeptide. This will resultingly achieve the same effect as a loss of function mutation. In particular, antisense RNA vectors may be used in the alternative.

Bone deposition can also be increased as an alternative method. A nucleic acid sequence can be selected, including Wise, Sost, or LRP. A nucleic acid sequence is then used to form a plasmid vector whereby the vector is used to transfect the host cell. The host cell will express the nucleic acid sequence to produce a polypeptide. Once a sufficient amount of polypeptide is produced it can be harvested for use in immunizing a host organism. Available host organisms include mice, rats, goats, rabbits, and any of a variety of other organisms used to produce polypeptides. The immunized host organism will produce antibodies to the polypeptide that was used to immunize the host. After a period of time the antibodies may be isolated and separated from the host. The antibodies can be used as is or can be further treated to produce Fab fragments or related small molecules. Regardless of the selected form of the antibody it can be combined with a carrier. Any of a variety of carriers are available for use including liposomes. The carrier antibody combination is used to transfect a host cell. This can be done either in vitro or in vivo. The antibody will bind to the selected target polypeptide and prevent activation of a selected pathway. This process can also be used in association with the Wnt pathway, tooth development or ocular development.

Any of a variety of kits may be formed both to the polypeptides or the nucleic acid sequences of the previously mentioned constituents. The kits can be used to detect the presence of a particular nucleic acid sequence or polypeptide or the absence of such composition.

BRIEF DESCRIPTION OF DRAWINGS

The application file contains at least one photograph executed in color. Copies of this patent application with color photographs will be provided by the Office upon request and payment of the necessary fee.

FIG. 1 shows the isolation of Wise by *Xenopus* animal cap screening;

FIG. 2A shows the alignment of the predicted amino acid sequence of Zebrafish, *Xenopus*, chick, mouse, and human Wise proteins. Shaded boxes represent identical amino acids between species; asterisks indicate residues conserved in *Drosophila* Slit, and dots identify residues conserved in Cef10. Circles mark conserved cysteine residues. The arrowhead delineates the site of signal peptide cleavage predicted in the chick clone;

FIG. 2B is a diagram showing alignment of conserved amino acids between Wise, Slit, and Cef10 (a CCN family member). Filled ovals and red lines indicate cysteine residues in the Slit homology domain conserved in the CT domain of CCN family members but not in Wise or Slit. Dotted lines show other conserved amino acids. Shaded boxes in Wise indicate three blocks Δ1, Δ2, Δ3 deleted separately for functional analysis;

FIG. 2C shows Western blot detecting HA-tagged Wise protein secreted into the medium following RNA injection into oocytes and control uninjected oocytes;

FIGS. 2D and 2E show the recombination between Noggin-expressing and Wise-expressing animal caps assayed for expression of Krox 20 (FIG. 2D) or en2 (FIG. 2E). Wise induces a ring of En2 (en) expression or patches of Krox20 staining in a non-cell autonomous manner in the Noggin cap. In FIG. 2D, the Noggin-injected cap was marked with FlDx, and in FIG. 2E, the Wise cap was marked with lacZ, as lineage tracers;

FIGS. 3A-3D shows the in situ hybridization of chick embryos. Wise is expressed in the surface ectoderm from the level of presomitic mesoderm to the posterior end at stage 10 (FIG. 3A). Higher transcript levels are detected at stage 11 (FIG. 3B), which refine to a small posterior domain by stage 12 (FIG. 3C). In FIG. 3D, a section of FIG. 3A, in the vicinity of Hensen's node shows Wise transcripts confined to the surface ectoderm (se);

FIG. 3E shows the RNase protection of Xenopus embryos with stages noted above each lane. Wise is first detected at an early gastrula stage, and the expression persists into tadpole stages. ODC is a loading control;

FIGS. 3F and 3G shows the whole mount in situ hybridization to Xenopus embryos. At stage 15 (FIG. 3F), Wise is expressed in the surface ectoderm at all anterior-posterior levels. The expression is strongest at the edge of the neural tube. At tadpole stages (FIG. 3G, stage 40), expression is localized in epibranchial placodes, lateral lines, and along the dorsal fin;

FIGS. 4A-4L shows in situ hybridization with neural markers in stage 16-21 Xenopus embryos following single blastomere injections of Wise RNA (FIGS. 4B, 4E, 4H, and 4K) at the 8-cell stage or antisense morpholino oligos (FIGS. 4C, 4F, 4I, and 4L) at the 4-cell stage. The left panels (FIGS. 4A, 4D, 4G, and 4J) indicate control embryos. In most embryos, lacZ (blue staining) was co-injected as a lineage tracer. Injected sides are to the left. Probes were Sox3 (FIGS. 4A-4C), En2 (FIGS. 4D-4F), Krox20 (FIGS. 4G-4I), and Slug (FIGS. 4J-4L). In Wise RNA injected embryos, the neural markers were generally displaced posteriorly. Ectopic induction of Krox20 and Slug can be seen in the forebrain region (FIGS. 4H and 4K). In embryos injected with antisense morpholino oligos, these markers were unchanged;

FIGS. 4M and 4N show the transverse sections at stage 16 after blastomere injection of either Wise RNA (FIG. 4M) or Wise antisense morpholino oligo (FIG. 4N). In FIG. 4M, the neural plate on the injected side was greatly expanded, which is revealed by Sox3 staining (dark blue, *). Conversely, in the morpholino oligo-injected embryo (FIG. 4N), the surface ectoderm is thicker on the injected side (left, *) in comparison to the right control side;

FIGS. 5A-5L shows in situ hybridization with the cement gland marker XCG at stage 16-20 (FIGS. 5A-5C) and morphological phenotypes of cement gland at stage 26-40 (FIGS. 5D-5F) or eye at stage 35-36 (FIGS. 5G-5I), in control embryos (FIGS. 5A, 5D, and 5G), Wise RNA injected embryos (5B, 5E, 5H), and morpholino oligo injected (FIGS. 5C, 5F, and 5I) embryos. Blue staining shows co-injected lacZ lineage tracer. Over-expression of Wise resulted in formation of larger cement glands (FIG. 5C). Eye formation is consistently blocked by injection of both Wise RNA (FIG. 5H) and the morpholino oligo (FIG. 5I);

FIG. 5J shows in vitro translation of Wise in the presence of the Wise morpholino antisense oligo. Lane 1; translation of Wise protein without morpholino oligo. Lanes 2-7; translation in the presence of the Wise morpholino oligo at concentrations of 0.1 nM, 1 nM, 10 nM, 100 nM, 1 μM, 10 μM, respectively. Lane 8; translation in the presence of control morpholino oligo at the concentration of 10 μM. Wise translation is partially blocked at concentration of 1 μM, and completely blocked at 10 μM;

FIG. 5K shows the rescue of the eye defect resulting from injection of the morpholino oligos by co-injection of Wise RNA;

FIGS. 5L-5N are the phenotypes of embryos following injection of Wise morpholino oligos throughout the whole embryo. 5L shows the range of cyclopic eye and short trunk phenotypes induced by the oligos in comparison to the control embryo (left). Section of control (FIG. 5M) and morpholino-injected (FIG. 5N) embryos at the level of eye. In the Wise morpholino-injected embryos, eyes are positioned very close to the neural tube;

FIG. 6 shows that Wise requires components of the Wnt pathway for En2 induction and stimulates translocation of β-catenin to the nucleus;

FIGS. 6A-6C show the RT-PCR of Noggin treated animal caps assayed for En2 (en) induction. NCAM is used as a pan neural marker and Ef1 a is a loading control. FIG. 6A shows the induction of En2 by Wnt8 or Wise RNA is blocked by dominant-negative (dn) Frizzled 8 ΔFz8. FIG. 6B shows the induction of En2 is blocked by dn-Wnt8 (Wnt8), dn-Dishevelled ΔDsh(dd1), GSK3 and dn-Lef1 (LEFΔN). FIG. 6C shows the induction of En2 requires signaling components of the canonical Wnt pathway but not the planar cell polarity (PCP) pathway. Wise-mediated En2 induction is abolished by ΔDsh(dd1), a dominant negative form of Dishevelled for both pathways, and ΔDsh(DIX), which blocks the canonical pathway. ΔDsh(DEP) blocks the PCP pathway but has no effect on Wise induction of En. ΔDshΔN specifically activates the PCP pathway but fails to induce En in the absence of Wise, although full length dishevelled (Dsh) is able to do so;

FIGS. 6D-6G show the staining for sub-cellular localization of endogenous β-catenin detected immunocytochemically in Xenopus animal caps following RNA injection of: FIG. 6D, TCF3; 6E, Wnt8+TCF3; FIG. 6F, Wise+TCF3; and FIG. 6G, β-catenin+TCF3. Wnt8 (FIG. 6E) and Wise (FIG. 6F) promoted accumulation of nuclear β-catenin;

FIG. 7 shows how Wise affects Wnt signaling;

FIGS. 7A-7C show the secondary axes induced by Wnt8 are blocked by Wise. Injection of Wnt8 RNA into a ventral vegetal blastomere of 4-8-cell stage embryos induces complete secondary axis formation (FIG. 7A). Co-injecting Wise blocks formation of Wnt8-induced secondary axis (FIG. 7B), similar to the effect obtained by co-injection of a dominant negative Dishevelled, ΔDsh(DIX) (FIG. 7C);

FIG. 7D shows Wise functions extracellularly to block induction of siamois and Xnr3 by the Wnt pathway in ventral marginal zones. Wise blocks the ability of Wnt8 to induce Siamois and Xnr3, but does not interfere with the ability of Dishevelled (Dsh) or β-catenin (β-cat) to induce these markers;

FIGS. 7E and 7F show that Wise acts as Wnt inhibitor and induces head development in the incomplete secondary axis. When BMP signaling is blocked at the ventral marginal zone by injection of a truncated BMP receptor (tBR), an incomplete secondary axis is formed (FIG. 7E). Co-injection of tBR and Wise induces a complete secondary axis with eyes (arrows) and cement gland (FIG. 7F);

FIGS. 7G-7I show that Wise blocks cell movements in Activin-treated animal caps. Control animal caps (FIG. 7G) undergo gastrulation-like movements in the presence of Activin (FIG. 7H). In Wise injected animal caps, elongation is blocked (FIG. 7I), but mesoderm induction occurs;

FIG. 8A shows that Frizzled binds to Wise, as well as to Wnt8;

FIG. 8B shows that Wnt8 interacts with Fz1 but not with Wise; and,

FIG. 8C shows that Wise interacts with Fz1, Fz3, Fz7, and Fz8;

FIGS. 8A-8C, in the top panels are controls showing that the Myc-tagged versions of each protein are present and recognized by the anti-Myc antibody. The middle panels are controls showing the presence of proteins tagged with FLAG and recognized by the anti-FLAG antibody. The bottom panels illustrate results of immuno-precipitation using the anti-Myc antibody and Western blotting with anti-FLAG to show protein interactions. The antibodies used in each set of experiments are indicated at the left;

FIG. 9A depicts the Neo-LacZ cassette insertion into Exon 1, which is separated from Exon 2 by an intervening intron sequence;

FIG. 9E shows the family of cysteine knot proteins and their aligned polypeptide sequences;

FIG. 11A shows that Wise and Sost defects lead to morphological abnormalities in Xenopus tadpoles;

FIG. 11B is a table showing Wise and Sost effects on Noggin and Wnt8 expression in embryos;

FIG. 11C depicts Sost effects for Wnt8 and β-catenin with VMZ and DMZ;

FIG. 11D shows electrophoretic patterns for NCAM, En2 and EF1-α;

FIG. 11E shows electrophoretic patterns for Siamois, Xnr3, and EF1-α;

FIG. 12A shows whole eye mounts containing retinas or sections that were stained with anti-Wise antibody and FITC-conjugated second antibody;

FIG. 12B shows that in wild type mice, anti-Wise reactivity was detected as secreted Wise protein in the ganglion cell and optic fiber layers and in rods and cones. However, Wise mutant mice eyes lacked detectable anti-Wise peptide reactivity, indicating absence of Wise from tissues of these mutant mice. The Wise mutant mice appeared to have lost the majority of the optic nerve fibers and had increased rod and cone layers in the retina. Wise protein was found in the inner plexiform layer, ganglion cells and fibers, and in the rods and cone layer of a 2.5 month mouse retina;

FIG. 12C shows immunoflurescence patterns for Wise, Pax6 and 2H3 in tissue cross-sections;

FIG. 13A depicts hematoxylin and eosin (H&E) staining of cross-sections of bone tissue from 16 to 18 days post cortum (DPC) mice;

FIG. 13B illustrates the same bone regions as FIG. 13A; however, FIG. 13B left shows staining with S-35 radiolabel attached to Sost RNA probes, wherein Sost is located in osteoblasts in 16 to 18 DPC mice. FIG. 13B right also shows staining with anti-Wise peptide primary antibody and FITC-conjugated secondary antibody, and localization of Wise in hypertrophic and prehypertrophic proliferating chondrocytes;

FIG. 13C shows graphical depictions of bone density measurements and total bone weight measurements, respectively. FIG. 13C left shows that observable significant differences in BMD measurements between Wise mutant and wild type mice at certain ages. FIG. 13C right depicts total bone weight measurements. FIG. 13 generally shows both Sost and Wise genes appear to affect bone cells. Sost is expressed in osteoblasts. In contrast, Wise is expressed in periosteum, chondrocytes (proliferating, prehypertrophic and hypertrophic), but not in the growth plate;

DETAILED DESCRIPTION

The present invention relates to a family of nucleic acid molecules, which encode polypeptides that bind to LRP and likely regulate the Wnt pathway and, resultingly, regulate bone deposition. The polypeptides will also regulate ocular and tooth development. The present invention further relates to proteins and polypeptides, or amino acid sequences, expressed from the family of nucleic acid molecules, which regulate bone deposition through LRP interaction. In particular, a nucleic acid molecule family, which includes the Wise and Sost genes, can be used with the present invention, as well as the family of amino acid sequences expressed therefrom. When the above family of amino acid sequences, including Wise and Sost, are allowed to bind to an LRP protein, bone deposition is regulated. When the family of amino acid sequences are prevented from binding to an LRP protein, deposition of bone will increase.

Antisense RNAs or oligonucleotides can be used to block translation of mRNA related to or translated from the above described nucleic acid molecules—in particular, the LRP binding family of amino acid sequences and polypeptides can cause increased bone deposition and likely activate the LRP/Wnt pathway. Similarly, inhibitor peptides and polypeptides prevent the above family of amino acid sequences from binding to an LRP to thereby increase bone deposition. As such, the present invention includes the above listed methods, nucleic acid molecules, amino acid sequence or polypeptide molecules, as well as related compositions and methods designed to prevent or inhibit binding by the LRP binding protein family to LRP. These tools can also be used to effect phenotypic changes. Specifically, mutants versions of Wise or Sost will cause phenotypic changes. Kits are described for detection of the above native nucleic acid molecules and amino acid sequence molecules. Kits are described for detection of mutant or variant forms of the aforementioned nucleic acid molecules, detection of expressed polypeptides or proteins, and measurement of corresponding levels of protein expression.

Figures 9A, 9B:
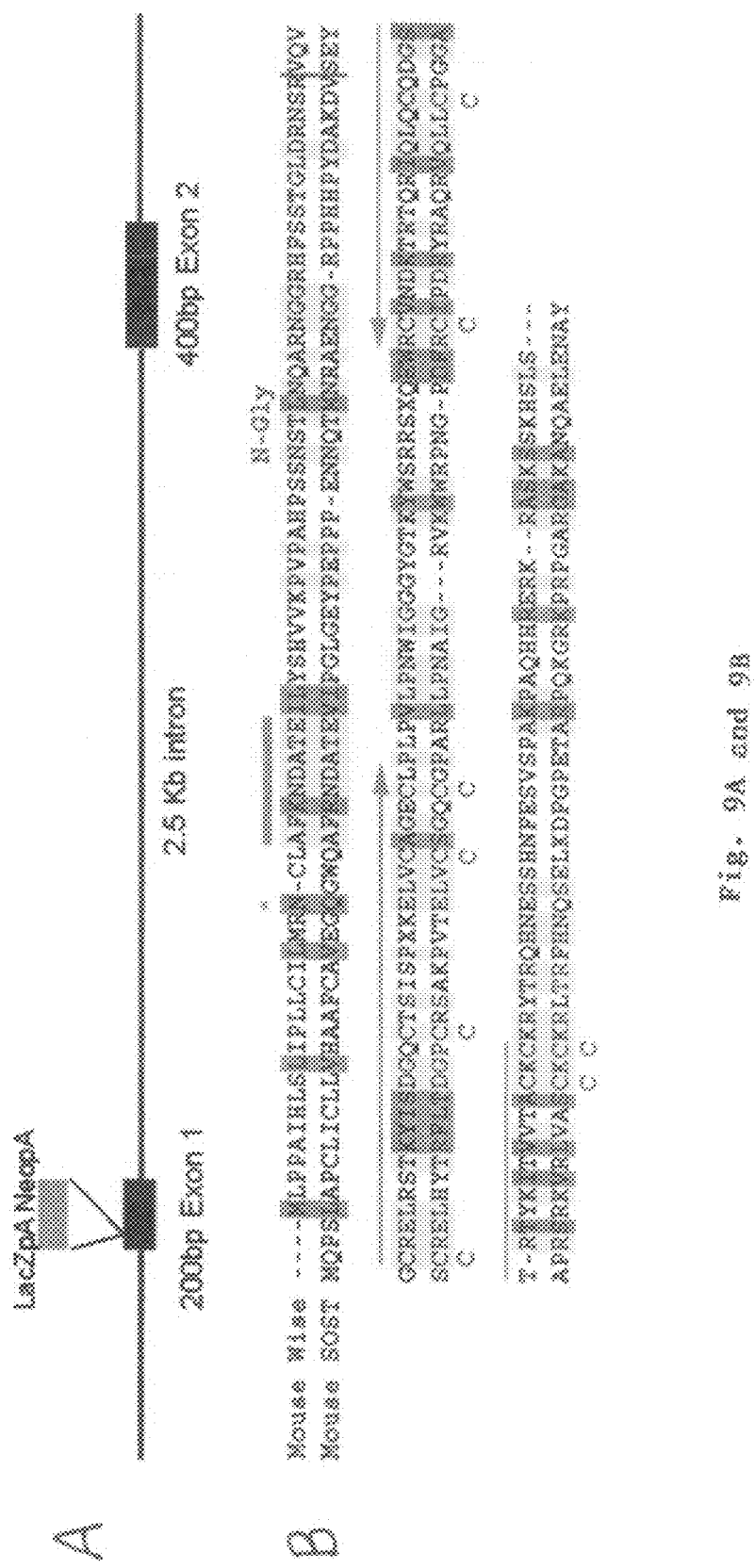
FIG. 9A is a schematic showing the gene structure for Wise and Sost.
FIG. 9B shows mouse Wise and Sost polypeptide sequences.
Figure 9C:
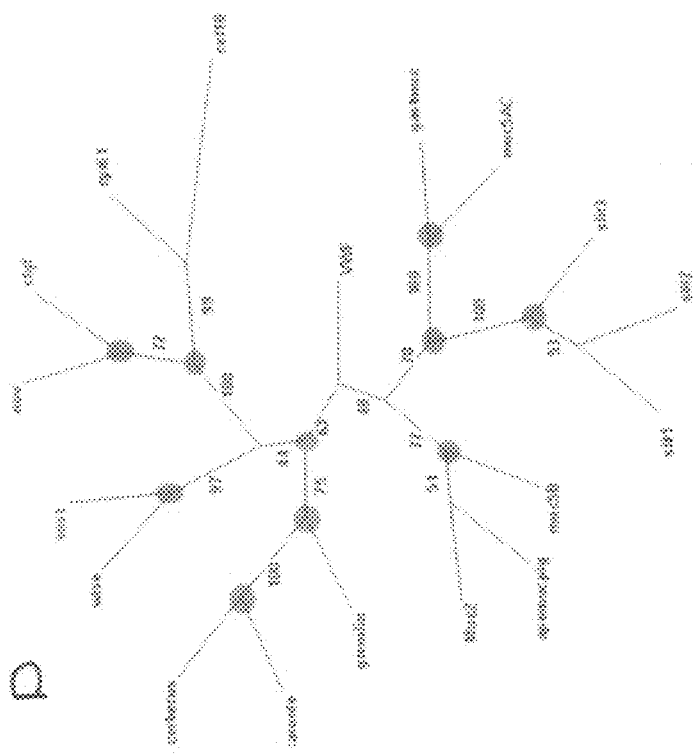
FIG. 9C shows Wise, Sost, and Hox A and B genes in chromosomes.
Figure 10:
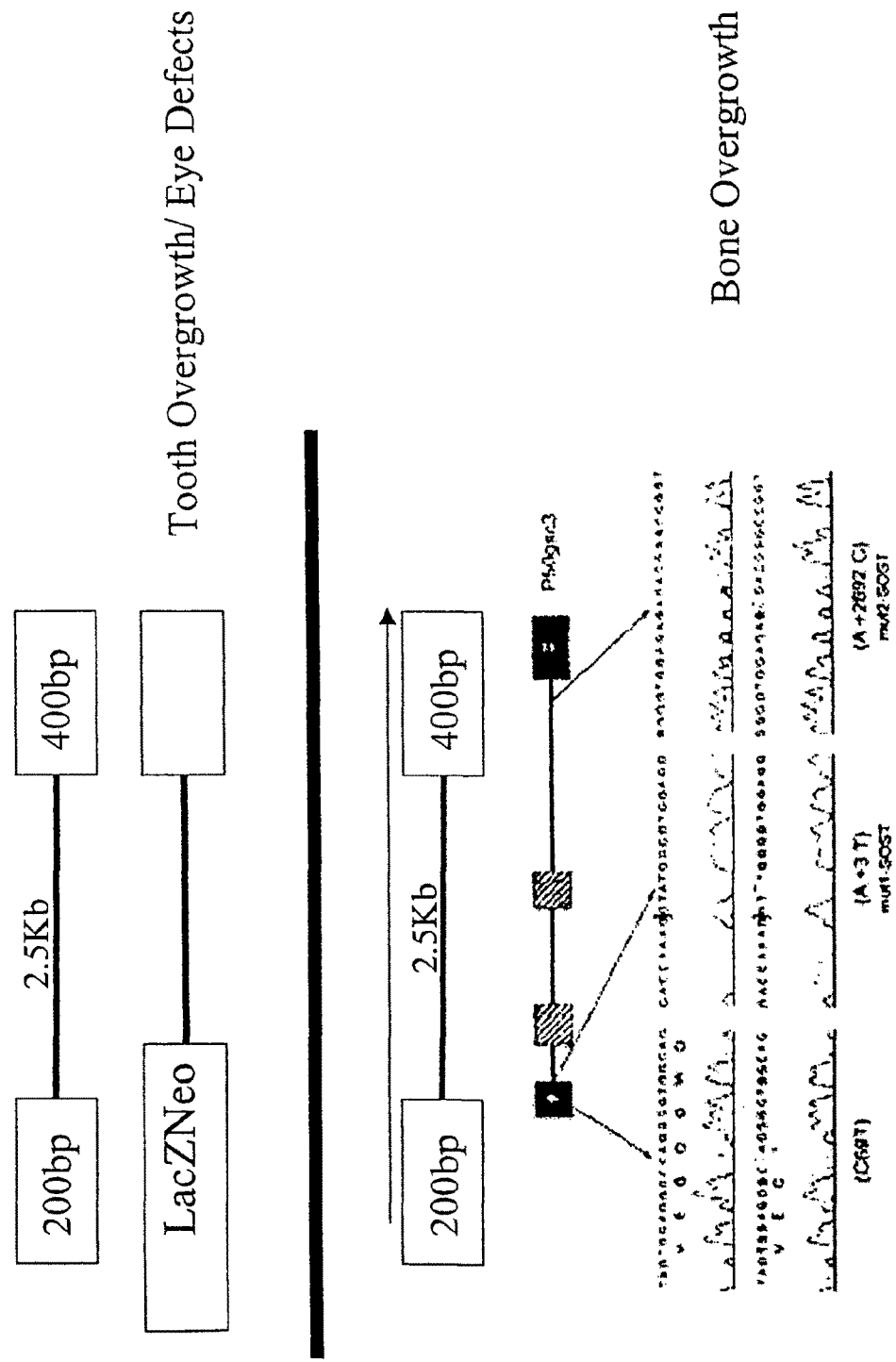
FIG. 10 is a model of the Wise and SOST Exons, which express the cysteine knot structure. It depicts the 200 bp of Exon 1 and the 400 bp of Exon 2.
Figure 11:
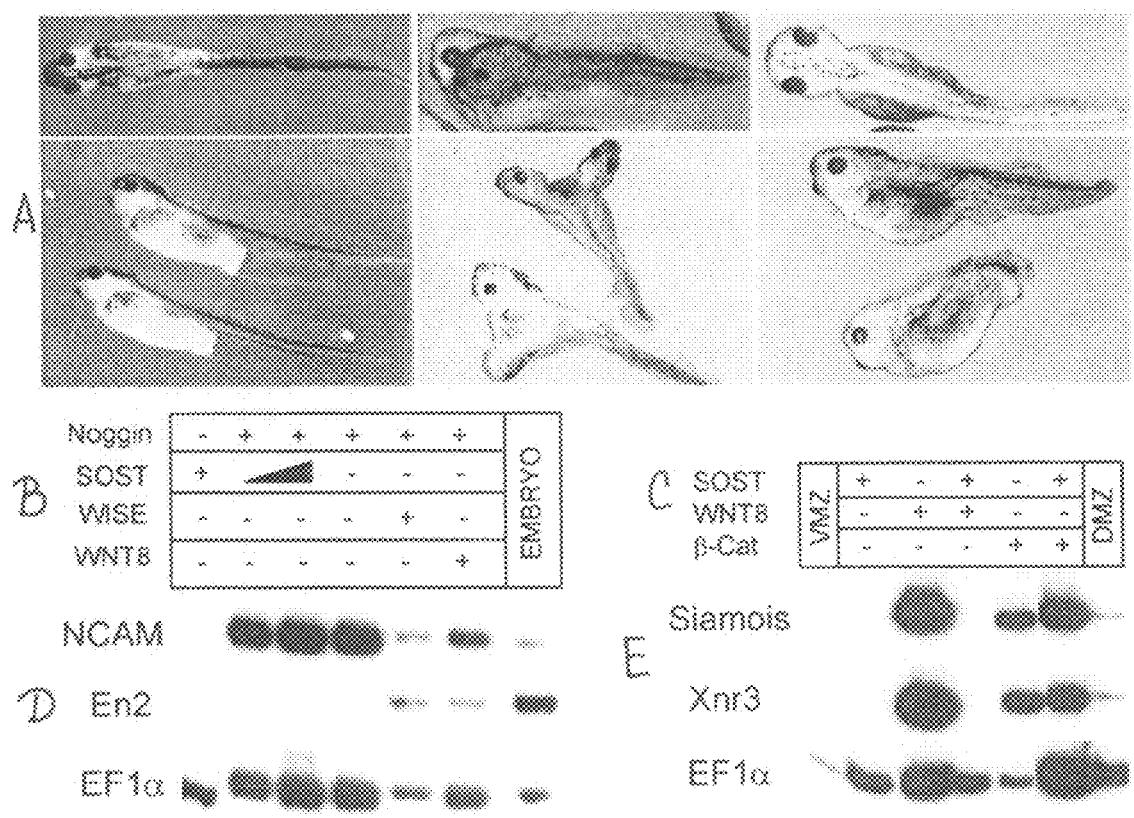
FIG. 11 shows the effects of Sost and Wise polypeptides on Xenopus embryonic development.

The novel Wnt inhibitor, Wise, has been isolated in the present invention. Wise affects craniofacial anterior-posterior patterning. The biochemical function of craniofacial A-P patterning is generally addressed in the present invention. Previously, it was shown that when chick somites were transplanted to more anterior locations, an anterior shift in Hox gene expression was observed. This shift in expression resulted in a posteriorization of the more anterior neural tissue. A screen for molecules involved in this process lead to the isolation of Wise. Wise is a secreted molecule that, until now, has not been shown to share much homology to any known molecules. Its gene structure contains two exons (200 and 400 bp) with a large 2.5 Kb intron (FIG. 10). The second exon encodes a cysteine knot motif, which bears some homology to known DAN, and CCN family members (FIGS. 9, 10, 11). Wise is mapped to Human chromosome 7p21.1, which in turn is linked to the HoxA cluster by 10.6 Mb (FIG. 9C). The four mammalian Hox clusters are thought to have evolved from a single cluster, as in *Drosophila*, therefore other clusters were searched for a possible Wise family member. Nothing was found that linked to the HoxD cluster, however, it was found that both HoxB and HoxC clusters had an ORF that was examined further. The HoxC cluster ORF, at 4 Mb upstream shares homology to the CCN family. The HoxB cluster contained an ORF at 5 Mb upstream. The HoxB ORF encodes a known gene, Sost. Sost was positionally cloned because of a familial mutation affecting bone density. Sost and Wise both share the same gene structure, and produce a secreted protein whose second exon (70% homologous) encodes for a cysteine knot. Unlike the known cysteine knot from DAN or CCN family members, Wise and Sost cysteine knots contain 8 cysteines instead of 9 like CCN and DAN families. Other molecules, Mucin2 and VWF have cysteine knots containing 10 cysteines, but are arranged in a manner similar to both the CCN and DAN family. DAN and CCN cysteine knots share about 50% homology to those of Wise and Sost. In addition to the cysteine knot domain, CCN proteins also encode for Insulin binding, Von Willderbrand, and TSP1 domains. However, the DAN family appears to only encode for a cysteine knot domain. Other genes that encode a cysteine knot domain include Slits, VWF, Mucins, and NDP.

A new Wise family member, Sost, has been characterized herein. Both Wise and Sost are linked to a Hox cluster further supporting Hox cluster duplication hypotheses. Sost functions like Wise to inhibit the Wnt pathway, however, unlike Wise, Sost is unable to induce En2 expression. The inability to induce En2 is very similar to other cysteine knot family members, like CTGF and Nov.

A family of genes and related proteins or polypeptides was isolated, which likely bind to LRP and likely regulates the LRP/Wnt pathway and causes regulation of bone deposition. The family of genes includes NDP, Dan, Caronte, PDGF, Wise, Sost, Cereberus, Gremlin, CTGF, Soggy, Dkk1, Cyr61, Dkk2, Dkk3, Dkk4, Nov, Mucin, Slit, OH, WISP, and CCN. Proteins expressed therefrom form a related amino acid sequence family. These nucleic acid molecules include sequences identified as SEQ ID NOs 1-44, 96-103, 105, 108, 110-113, and 126-128, and amino acid sequences identified as SEQ ID NOs 45-95, 104-107, 109, 114-125. When the above genes of the family are turned off, or mutagenized, the LRP pathway typically is not regulated and deposition of bone will increase. More particularly, the gene-encoded proteins do not bind to LRP, resulting in increased bone deposition. The gene-expressed proteins can be blocked to prevent regulation of the LRP pathway. Thus, the present invention relates to nucleic acid molecules and amino acid sequences and other tools and methods used to inhibit, block or deactivate binding of the LRP binding family to LRP. Inhibition of Wnt signaling can occur with resultant blocking or deactivation of the LRP binding family to LRP.

Related to this, it is known that mutant Wise and Sost polypeptides cause phenotypic changes in bone deposition, ocular development and tooth development. Regardless of interaction with LRP it is determined that mutants of Sost or Wise, or antibodies which attach to Sost or Wise, will cause phenotypic changes.

The above gene family and related proteins can not only be characterized as binding to or blocking binding to LRP, but as a gene family that expresses related proteins that each possess at least one cysteine knot. The cysteine knot is generally formed by 8 cysteine residues, which are readily conserved. However, other knots may have fewer or more residues. Typically, a guanine is part of the structure and conserved. Guanine will, along with two other amino acids, separate two cysteines located in one arm. For example, the gene family contains the genes Sost, Wise, Dkk1, Dkk2, OH, WISP, and CTGF. These genes include an exon region (e.g., Exon 2), which expresses a protein or amino acid sequence molecule, which has a cysteine knot and binds to LRP.

Wise genes and polypeptides that have been specifically isolated, including wild types, alleles, mutants, synthetic versions and any other related homologous nucleic acid sequences, are used herewith. Wise contains two exons, with Exon 2 considered the most important. Exon 2, when expressed, produces a polypeptide that has a cysteine knot.

The present invention includes the LRP binding family of polypeptide molecules, such as Wise, Sost, Dkk1, Dkk2, and CTGF, that binds to LRP, which will, in turn, likely bind to Wnt. The LRP proteins and related genes will include LRP 1-11, and Arrow. LRPs that have been found to be specifically related to the present include LRP1,2,5, and 6. Available LRP nucleic acid sequence, are SEQ ID NOs 29-43, polypeptide SEQ ID Nos 67-88.

The present invention also relates to antisense RNA (asRNA) complementary to an mRNA from the LRP binding nucleic acid family, in particular Wise and Sost, whereby the asRNA will inhibit the members. An RNA may also be used to induce post-transcriptional gene silencing. This RNAi will cause translation of the gene family to cease. Any RNA/DNA that is complementary to the mRNA related to the discussed gene family, can be used to destroy a family member. Other mutants include point frame shift, deletion, truncated, base substituted, and less of function mutations. The loss of function mutations are made with a stop codon. Additionally, a polyclonal or monoclonal anti-peptide antibody to the cysteine knot antigenic region may be used for detection or inhibition. This antibody would inhibit interaction with LRP. The antibody can also be directed to the entire Wise or Sost polypeptide. A point mutation may be made in a nucleic acid sequence member of the gene family, whereby the expressed protein or polypeptide cannot bind LRP. Alternatively, an antisense oligonucleotide can be used, which will prevent translation of mRNA and thereby inhibit binding to LRP. An anti-polypeptide antibody can be used to bind to LRP and prevent binding with a cysteine knot protein, preferably functioning by a steric hinderance mechanism.

Mutant alleles of the LRP binding gene family can express a protein or amino acid sequence that will not bind LRP and thereby increase bone deposition. As discussed, expression of such a mutant can be therapeutically desirable, especially when used as a method for producing stronger bones or increased recovery from bone disease. Thus, the present invention relates to mutants of the listed gene family. The present invention includes administration of such mutant polypeptide products that can result in increased bone deposition.

Antibodies, which specifically bind to the above proteins and probes for isolating the proteins or nucleic acid molecules, are further part of the present invention. Fab fragments can be derived from the antibodies. Yet another part of the present invention relates to methods for increasing bone deposition by preventing the protein family from binding to an LRP and, in turn, likely regulating the Wnt pathway. The invention includes methods for blocking expression of the nucleic acid molecules, and methods for preventing the amino acid sequences from binding to Wnt or LRP. Kits are also part of the invention which detect mutants and non-mutants of the nucleic acid molecules, and their expressed amino acid sequences or polypeptide molecules. As such, the present invention includes diagnostic and therapeutic methods and kits for the prediction, assessment, and regulation of bone deposition.

Nucleic acid sequences complementary to the previously listed nucleic acid molecules, preferably the mutants, of the gene family may also be used with the present invention. As expected, such a complementary nucleic acid sequence is one that can be expressed to form a protein or amino acid sequence that binds to LRP and regulates bone deposition. The complementary sequence can also be used to prevent binding of LRP and, thus, increase bone deposition. A complementary nucleic acid sequence from a member of the LRP binding gene family can be made to produce an expressed polypeptide that can impact binding to LRP and ultimately regulate bone deposition. Further, degenerate variants of the sequences may be used. Also, isolated nucleic acid molecules that encode the LRP binding family protein or amino acid sequence may be used in the present invention.

Nucleic acid molecules homologous to the wild type nucleic acid molecules, and the mutant nucleic acid molecules, may be used to regulate or cause increased bone deposition. The homologous nucleic acid molecules are identified using a BLAST (Basic Alignment Search Tool) (NCBI) sequence method. Suitable homology will include those nucleic acid molecules that are 50% homologous to the listed mutant alleles, or non-mutants. More preferably, the homology will be 60% and, even more preferred, 75% homologous to the mutant alleles, or non-mutants. The most preferred homologous nucleic acid molecule will be 90% homologous to the mutant alleles, or non-mutants (i.e. wild type), in particular, Wise, Sost, and mutants thereof. Homologous nucleic acid molecules may be derived from animals, including, but not limited to, humans, non-human mammals, amphibians, and insects.

Isolated nucleic acid sequences, such as oligonucleotides, can be derived from the nucleic acid molecules, which are the active portions of the molecules, to bind with LRP, mRNA, or ultimately prevent binding of the LRP protein. Such oligonucleotides are a part of the present invention. The active region, which forms the oligonucleotide molecules, includes the cysteine knot region. More particularly, a region which expresses a cysteine knot sequence that binds to LRP can be used. Conversely, oligonucleotides related to the mutant forms of the genes can be used to prevent regulation of bone deposition.

Expression vectors, which regulate bone deposition, can be formed that contain the above-discussed nucleic acid molecules, using known procedures. A promoter can be operably linked to the isolated nucleic acid molecule to form the expression vector. Any promoter can be used which causes expression of the nucleic acid molecule, and can be switched on and off. It is further preferred to include a marker with the vector. Suitable vectors include DNA vectors, plasmid vectors, and shuttle vectors.

Vectors are formed from both the isolated nucleic acid sequences and the mutant versions of the isolated nucleic acid sequences. The vectors include expression, cloning, and viral vectors. Other available vectors include fusion vectors, gene therapy vectors, two-hybrid vectors, reverse two-hybrid vectors, sequencing vectors, and cloning vectors. Also, prokaryotic and eukaryotic vectors may be used. Specific prokaryotic vectors that may be used in the present invention include pET, pET28, pcDNA3.1/V5-His-TOPO, pCS2+, pcDNA II, pSL301, pSE280, pSE380, pSE420, pTrcHis, pRSET, pGEMEX-1, pGEMEX-2, pTrc99A, pKK223-3, pGEX, pEZZ18, pRIT2T, pMC1871, pKK233-2, pKK38801, and pProEx-HT. Specific eukaryotic vectors that may be used herein include pFastBac, pFastBac HT, pFastBac DUAL, pSFV, pTet-Splice, pEUK-C1, pPUR, pMAM, pMAMneo, pBI101, pBI121, pDR, pCMVEBNA, YACneo, pSVK3, pSVL, pMSG, pCH110, pKK232-8, p3'SS, pBlueBacIII, pCDM8, pcDNA1, pZeoSV, pcDNA3, pREP4, pCEP4, and pEBVHis. As mentioned, a variety of promoters may be used with the vector, as well as any of a variety of selectable markers. Available markers include antibiotic resistance genes, a tRNA gene, auxotrophic genes, toxic genes, phenotypic markers, colorimetric markers, antisence oligonucleotides, restriction endonuclease, enzyme cleavage sites, protein binding sites, and immunoglobulin binding sites. Specific selectable markers available include LacZ, neo, Fc, DIG, Myc, and FLAG.

Once the vectors are formed, they can be used to transfect a host cell, whereby a transgenic host cell will be produced that incorporates a vector that expresses the selected nucleic acid molecule, which prevents or causes bone deposition through interaction with the LRP. Such bone deposition may likely involve interaction with the Wnt pathway. Methods for transfecting the host cell are well known to those of skill in the art, and comprise culturing the vectors with the host cells.

The host cell can be derived from any of a variety of eukaryotic cell origins, including animal-, mammalian-, amphibian-, or insect-derived cells. More preferably, the host cells are derived from non-human mammals and humans. The preferred host cell is an osteoblast/osteoclast, chrondocytes.

Any of a variety of host cells, including prokaryotic and eukaryotic cells, can be transfected with the vectors previously mentioned. Prokaryotic host cells include Gram-negative and Gram-positive bacteriums may be transfected with any of the variety of vectors previously mentioned. Available bacteriums include *Escherichia, Salmonella, Proteus, Clostridium, Klebsiella, Bacillus, Streptomyces*, and *Pseudomonas*. A preferred Gram-negative bacterium is *Escherichia coli*. Eukaryotic vectors can be used to transfect eukaryotic host cells including yeast, plant, fish, mammalian, human, mouse, frog, or insect cells. Specific host cells that can be transfected include ES, COS, HEK 293, CHO, SaOS, osteosarcomas, KS483, MG-63, primary osteoblasts, osteoclasts, chrondocytes, and human or mammalian bone marrow stroma. As such, the present invention includes host cells transfected with any of the previously mentioned vectors.

A transgenic animal can be formed using the present invention. In particular, transgenic non-human animals can be formed by insertion of the wild type or mutant nucleic acid molecules into cells of a host animal. The insertion of nucleic acid molecules into host animal cells can occur by a variety of methods including but not limited to transfection, particle bombardment, electroporation, and microinjection. Insertions can be made into germ line, embryonic, or mature adult host animal cells.

The proteins or amino acid sequences expressed by the nucleic acid molecules, related mutants, and the listed nucleic acid molecules can activate LRP/Wnt and can be isolated and purified. Additionally, the mutants, asRNA molecules, as oligonucleotides, and anti-peptide antibodies can be developed and used to prevent binding to LRP or binding of Wise or Sost. The proteins or amino acid sequences from both the non-mutant and mutant nucleic acid molecules can also be isolated and purified. Such isolation and purification include known procedures and methods, including affinity chromatography or purification, as well as other methods. The isolated proteins include those listed herein. Additionally, suitable proteins or amino acid sequences include those that bind to LRP and Wnt, and prevent or cause activation, dependent upon the desired outcome.

Proteins, which are 90% homologous with the polypeptides lised in SEQ IDs are also included. As would be expected, polypeptides or proteins that are 50% homologous to the polypeptides may also be used, with proteins 60% homologous more preferred. A polypeptide that is 75% homologous to SEQ ID NOs 45-95, 104-107, 109, and 114-125 is even more preferred. As such, any of a variety of polypeptides may be used, as long as they are expressed by an LRP binding family member, Sost Wise, or homologous nucleic acid molecule, and prevent influence Wnt, Bone deposition, tooth development or ocular development. More preferably, mutants will be used. Resultingly, the proteins will cause increases of bone deposition to occur. Non-mutant, homologous amino acid sequences may be used. The extent of homology will be identical to that previously described above. Thus, sequences that are 50% homologous to the proteins or amino acid sequences may also be formed. More preferably, the sequences will be 75% homologous, and even more preferably, 90% homologous to the proteins.

Probes, which can be used to isolate, identify, and characterize the above proteins and/or genes, can be formed from such proteins or genes. The probes include cDNA, mRNA, and monoclonal and polyclonal antibodies. All the probes are formed using known procedures. Probes, which are 50% homologous to the proteins or amino acid sequence, may also be formed. More preferably, the probes will be 75% and, even more preferably, 90% homologous to the above proteins. The formula used to determine the homology of the probes is a BLAST sequence.

Antibodies, which specifically bind to the above-listed proteins, are part of the present invention. Additionally, hybridomas that produce such antibodies are used herewith. In addition to protein probes, cDNA probes may be formed, which are comprised of isolated nucleic acid molecules previously discussed. As such, any antibody that binds specifically to a Wnt binding family member, may be used. Antibodies that selectively bind to an epitope in the receptor-binding domain of the LRP/Wnt binding mutant protein may also be used. A non-mutant or wild type epitope may also be used.

A kit for detecting a LRP binding gene, or related nucleic acid molecule, can be formed. The kit will preferably have a container and a nucleic acid molecule, which includes any of the mentioned sequences.

A kit for detecting a LRP binding protein or amino acid molecule can also be formed. The kit will preferably have a container and a nucleic acid molecule, which includes any of the mentioned sequences.

The family of genes and proteins can be used as tools to develop asRNAs and polypeptides, which regulate LRP/Wnt.

Neural patterning in embryogenesis involves signaling between the neural plate and surrounding tissues. To investigate this process, a functional screen was performed using a cDNA library derived from chick tissues surrounding the neural tube. Activities that alter anteroposterior (A-P) character of neuralized Xenopus animal caps were assayed for, and a novel gene was identified, Wise, which was expressed in surface ectoderm. Wise encodes a secreted protein capable of inducing posterior neural markers. Importantly, the phenotypes arising from ectopic expression of Wise resemble those affected when Wnt signaling is altered. Induction of posterior markers by Wise likely requires components of the canonical Wnt pathway, showing that it activates the Wnt signaling cascade. In contrast, in other assays, such as secondary axis induction, Wise inhibits Wnt signaling. Wise protein interacts with LRP receptors, but not with Wnt, demonstrating that Wise is a novel ligand for LRP, which either activates or inhibits the signaling pathway. Hence, Wise differentially influences the Wnt signaling cascade in a context-dependent manner. These activities provide a novel mechanism that integrates and modulates the balance of Wnt signaling.

The following are definitions for terms used herein.

An animal cap is a pigmented animal hemisphere of the amphibian blastula. The vegetal becomes endoderm and part of the animal pole becomes ectoderm. In most animal oocytes the nucleus is not centrally placed, and its position can be used to define two poles. That nearest to the nucleus is the animal pole, and the other is the vegetal pole, with the animal-vegetal axis between the poles passing through the nucleus. During meiosis of the oocyte, the polar bodies are expelled at the animal pole. In many eggs, there is also a graded distribution of substances along this axis, with pigment granules often concentrated in the animal half and yolk region, when present, largely situated in the vegetal half.

The anterior-posterior axis is the body axis extending from the anterior to the posterior pole of a bilaterally symmetric embryo (or animal).

Blastomere is one of the cells produced as the result of cell division and cleavage, in the fertilized egg.

Blastula is the stage of embryonic development of animals near the end of cleavage but before gastrulation. In animals where cleavage or cell division involves the whole egg, the blastula usually consists of a hollow ball of cells.

Bone is continually deposited by osteoblasts. Normally, bone deposition and absorption are equal.

DNA cassette is a deoxyribonucleic acid (DNA) sequence that can be inserted into a cell's DNA sequence. The cell in which the DNA cassette is inserted can be a prokaryotic or eukaryotic cell. The prokaryotic cell may be a bacterial cell. The DNA cassette may include one or more markers, such as Neo and/or LacZ. The cassette may contain stop codons. In particular, a Neo-LacZ cassette is a DNA cassette that can be inserted into a cell's DNA sequence located in a bacterial artificial chromosome (BAC). Such DNA cassettes can be used in homologous recombination to insert specific DNA sequences into targeted areas in known genes.

The ectoderm is the germ layer that gives rise to the epidermis and nervous tissue.

The endoderm is the germ layer that gives rise to the respiratory organs, gut, and the gut accessory glands.

Gastrula is the stage of embryonic developments in animals when gastrulation occurs, and follows the blastula stage.

Gastrulation is the process by which cells of the blastoderm are translocated to new positions in the embryo, producing the three primary germ layers.

The germ layer is defined as the main divisions of tissue types in multicellular organisms. Diploblastic organisms (e.g., coelenterates) have two layers, ectoderm and endoderm; triploblastic organisms (i.e., all higher animal groups) have mesoderm between these two layers. Germ layers become distinguishable during late blastula/early gastrula stages of embryogenesis, and each gives rise to a characteristic set of tissues, the ectoderm to external epithelia and to the nervous system, for example, although some tissues contain elements derived from two layers.

Mesoderm is defined as the middle of the three germ layers; which gives rise to the musculo-skeletal, vascular, and urinogenital systems, to connective tissue (including that of dermis) and contributes to some gland formation.

Neural plate is defined as a region of embryonic ectodermal cells, called neuroectoderm, that lie directly above the notochord. During neuralation, the neuroectoderm changes shape, so as to produce an infolding of the neural plate (i.e., the neural fold) that then seals to form the neural tube.

The neural tube is the progenitor of the central nervous system.

Somites are defined as the blocks of tissue in the trunk derived from the originally unsegmented paraxial mesoderm.

Small molecules are defined as regulatory polypeptide or nucleic acid molecules that cause detectable changes in protein-protein interaction systems that may also affect one or more phenotypic changes. Interaction systems include, but are not limited to, Wise and Sost protein interaction with LRPs, the Wnt pathway, Engrailed, and Frizzled. These small molecules may operatively function by structural similarity to and competitive inhibition with native molecules in vitro or in vivo. Phenotypic changes may include observed changes in such parameters as bone deposition or bone mineral density, tooth development, and ocular development. Small regulatory polypeptide molecules include, but are not limited to, antibody fragments such as Fab, F(ab)$_2$, Fv, and antibody combining regions that bind with either Wise, Sost, or LRP; and shortened Wise, Sost or LRP polypeptide sequences. Small regulatory nucleic acid molecules include, but are not limited to, antisense RNA sequences that interfere with Wise, Sost, or LRP function; and truncated Wise, Sost or LRP nucleic acid sequences that encode shortened polypeptides that interfere with Wise, Sost or LRP function. An antisense Wise RNA is complementary to Wise sense RNA and operatively binds to it in a cell to prevent translation of native protein. A truncated Wise nucleic acid sequence encodes a shortened Wise polypeptide that can potentially competitively bind to LRP to prevent native Wise protein binding.

The vegetal pole is the surface of the egg opposite to the animal pole. Often the cytoplasm in this region is incorporated into future endoderm cells.

A vector is a self-replication DNA molecule that transfers a DNA segment to a host cell.

A host organism is an organism that receives a foreign biological molecule, including an antibody or genetic construct, such as a vector containing a gene.

Chimera is an individual composed of a mixture of genetically different cells. The genetically different cells of chimeras are required to be derived from genetically different zygotes.

Mutant is an organism bearing a mutant gene that expresses itself in the phenotype of the organism. Mutants include both changes to a nucleic acid sequence, as well as elimination of a sequence. In addition polypeptides can be expressed from the mutants.

Plasmids are double-stranded, closed DNA molecules ranging in size from 1 to 200 kilo-bases. Plasmids are vectors for transfecting a host with a nucleic acid molecule.

An amino acid (aminocarboxylic acid) is a component of proteins and peptides. Joining together of amino acids forms polypeptides. Polymers containing 50 or more amino acids are called proteins. All amino acids contain a central carbon atom to which an amino group, a carboxyl group, and a hydrogen atom are attached. Polypeptides can be referred to when a protein is less than 500 amino acids.

A nucleic acid is a nucleotide polymer better known as one of the monomeric units from which DNA or RNA polymers are constructed, it consists of a purine or pyrimidine base, a pentose, and a phosphoric acid group.

A gene is a hereditary unit that has one or more specific effects upon the phenotype of the organism that can mutate to various allelic forms.

A polypeptide is a polymer made up of less than 50 amino acids.

Knockout is an informal term coined for the generation of a mutant organism (generally a mouse) containing a null allele of a gene under study. Usually the animal is genetically engineered with specified wild-type alleles replaced with mutated ones.

Allele is a shorthand form for allelomorph, which is one of a series of possible alternative forms for a given gene differing in the DNA sequence and affecting the functioning of a single product.

Wild type is the most frequently observed phenotype, or the one arbitrarily designated as "normal". Often symbolized by "+" or "wt."

Finally, the phenotypes observed in Wise mutants are similar to that of Sost mutants. Some phenotypes examined in the Wise mutant may explain Sost phenotypes, i.e. loss of retinal nerve fibers may be reason for optic nerve atrophy. Interestingly, it has been demonstrated that Wise inhibits the Wnt pathway by binding to an area encompassing the first two YWTD propeller domains of LRP. In humans the autosomal recessive disorder OPPG has been mapped to the area upstream of the first YWTD propeller domain of LRP5. Also, LRP5 is found to be expressed in osteoblasts and in retinal cells of *Xenopus* embryos. The same expression pattern was found for humans. It has been demonstrated that the loss of LRP5 function leads to very low peak bone mass and visual loss. Thus, early during bone development, Wise may be acting to inhibit Wnts through LRP5; and later, the inhibition of Wnts may be the function of Sost.

EXAMPLES

Example 1

Functional screens in *Xenopus* were performed with the aim of identifying factors derived from tissues surrounding the neural tube that alter A-P patterning in Noggin-treated animal caps. Two clones were isolated, one encoded a truncated β-catenin and the other a novel secreted protein, which was named Wise. Isolation of the two clones is described below.

Figure 1A:
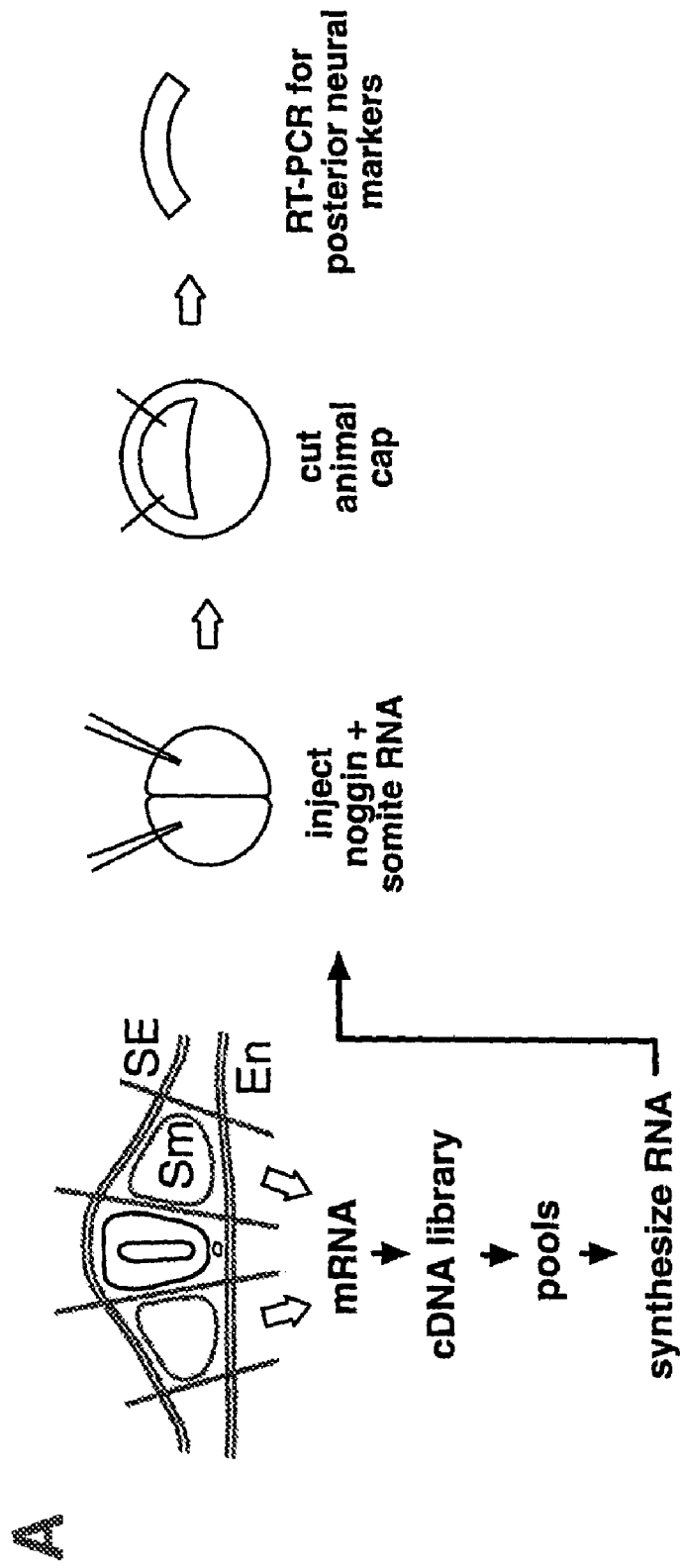
FIG. 1A shows an illustration of the screening procedure.

FIG. 1A provides an overview of how factors which impacted patterning were determined. Chick embryo somites, which are capable of transforming pre-otic rhombomeres into a more posterior neural tissue were collected together with overlying ectoderm and underlying endoderm. mRNA was collected from the tissue, which was then used to make a cDNA library. This provided a source of putative posteriorizing factors.

The cDNA library was made from stage 8-13, (Hamburger and Hamilton, 1951) chick embryos using tissues surrounding the neural tube (FIG. 1A) from axial levels capable of inducing Hoxb9 expression in grafting experiments (Itasaki et al., 1996). The library contained 250,000 un-amplified clones, and 50,000 of these were divided into 100 pools (500 clones per pool). For initial screening, 10 pools were mixed to prepare a single large DNA pool (5,000 clones) used to synthesize capped RNA. Size-selected (>1 kb) cDNAs were directionally inserted into a modified 64T vector (Tada et al., 1998).

*Xenopus* eggs were obtained, fertilized, cultured, and injected with the synethized RNA, as previously described (Jones and Smith, 1999). In the first round of screening, 250 picogram (pg) of Noggin RNA and 12 nanograms (ng) of library RNA were injected into each blastomere of 2-cell state *Xenopus* embryo. To examine embryo phenotypes, RNA was injected into specific blastomeres, together with lacZ or FIDx (Molecular Probes) as a lineage tracer. Markers were assayed with in situ hybridization.

Figures 1B, 1C:
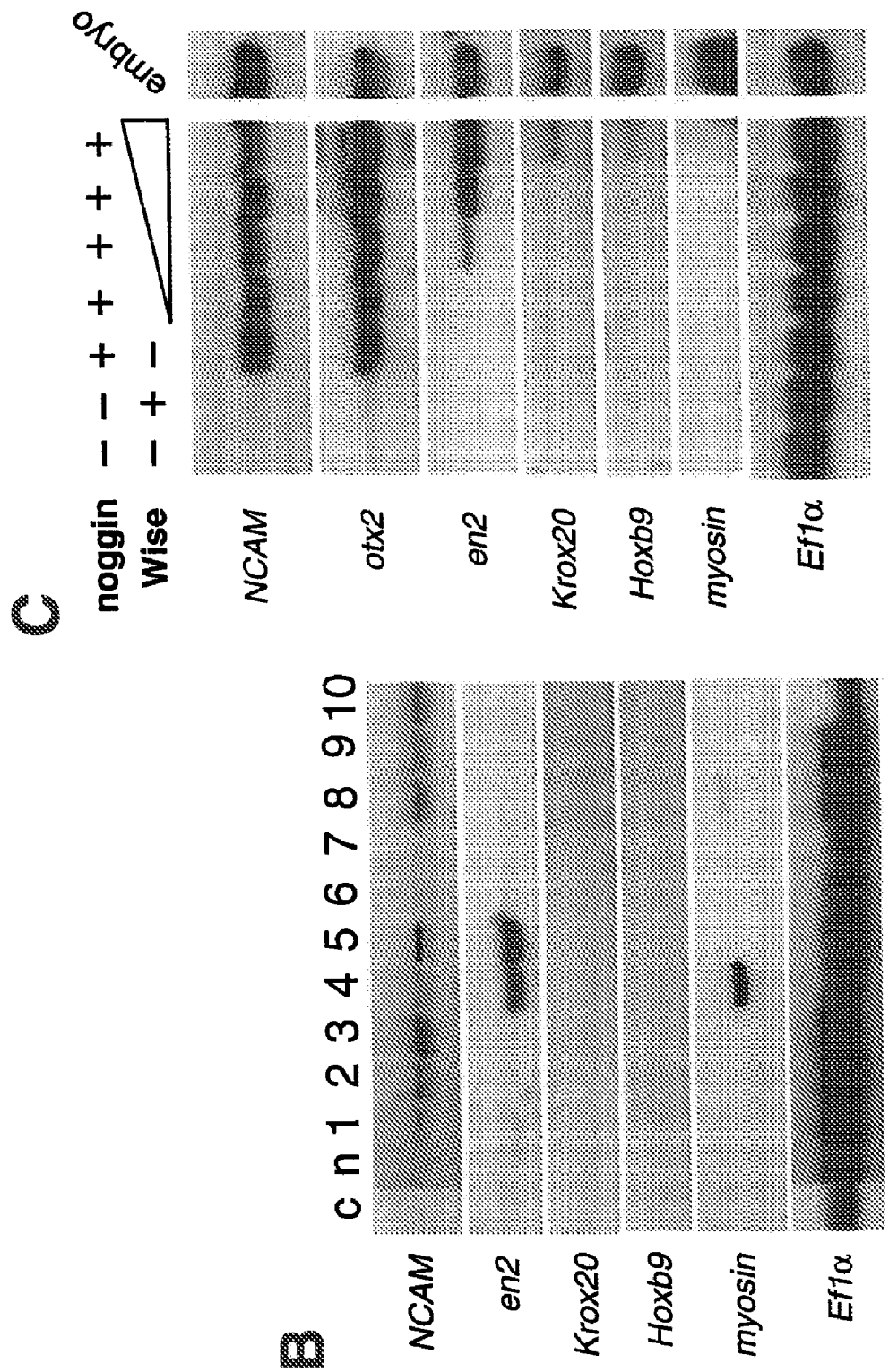
FIG. 1B shows the RT-PCR gel electrophoresis results of the first round of screening.
FIG. 1C shows the RT-PCR analysis of injections using RNA from the isolated Wise clone.

Following co-injection of Noggin RNA with pools of RNA from the cDNA library, the induction of posterior markers was monitored in animal caps by assaying for expression of En2, Krox20, and Hoxb9, which mark the midbrain, hindbrain, and spinal cord, respectively (FIGS. 1B and 1C). Myosin was also used as a marker for mesoderm induction, which allowed focus on pools that influence neural patterning in the absence of mesoderm.

Explants (excised tissue) were processed for RT-PCR to detect region-specific neural markers. The primers for Ef1a, NCAM, Otx2, En2, Krox20, Hoxb9, Myosin light chain and Muscle actin were used.

It was observed in pool 5, that En2 was induced in the absence of mesoderm (FIG. 1B). Successive rounds of subdivision and sib selection identified the clones responsible for this activity. From this pool, two distinct clones were isolated. One clone encoded an amino-terminally truncated form of β-catenin, a cytoskeletal component, and an intracellular target of the Wnt pathway. This result was consistent with data demonstrating that β-catenin has an ability to induce posterior neural markers in animal caps when co-injected with Noggin. The N-terminal truncation in the clone removed the first 87 amino acids, which included the sites for phosphorylation by GSK3β, which accelerated degradation of β-catenin protein. Therefore, the clone encoded a stable form of β-catenin able to stimulate Wnt signaling.

The second clone proved to encode a novel protein. Based on its characterization and relationship to Wnt signaling detailed in the study, the clone's gene was designated Wise (Wnt, inhibitor/activator in surface ectoderm). In the animal cap assays, injection of Wise RNA, together with Noggin, demonstrated that increasing concentrations of Wise progressively induced more posterior markers (En2 and Krox20) in the absence of mesoderm (FIG. 1C). Noggin equal to 500 pg and Wise equal to 150, 300, 600 and 1200 pg were injected. Wise alone exhibited no neural-inducing activity (no NCAM induction) and no ability to induce mesoderm, as confirmed using Myosin (FIG. 1C), Brachyury, Wnt8, and Xhox3 as markers. It was observed that increasing amounts of Wise RNA (150, 300, 600, and 1200 pg) progressively induced more posterior neural markers in the presence of Noggin. Wise DNA and RNA were obtained using standard molecular biology methods. Sambrook et al., Molecular Cloning: a Laboratory Manual, 3rd ed., Cold Spring Harbor, N.Y., Cold Spring Harbor Laboratory Press (2001).

For explant recombination assays, 500 pg of Noggin was injected into one set of embryos and 1 ng of Wise injected into a separate set. For lineage tracing, either FIDx was injected, along with Noggin RNA, or 100 pg of lacZ RNA was co-injected with Wise. Caps were cut at stage 8, combined and cultured for assay at stage 25.

Example 2

To isolate a frog clone, Xenopus stage 25 embryos were collected and a cDNA library was formed. This was used as a template for RT-PCR. Using degenerate primers, designed on the basis of conserved regions between chick and mouse Wise, ~500 bp fragments were sub-cloned into pBluescriptI-IKS (Stratagene) and sequenced. The degenerate primers used were upstream, SEQ ID NO 129: 5'-GCTTT(T/T)AA(A/G)AA(C/T)GATGCCAC-3'; and downstream, SEQ ID NO 130: 5'-GTGAC(T/C)AC(T/G/A)GT(T/G)ATTTTGTA-3'. Two different clones in the frog were identified (XWise-A and XWise-B) presumably resulting from the pseudotetraploid Xenopus genome. For each clone, 5' and 3' flanking sequences were identified by PCR using a Xenopus stage 35 cDNA library. Standard PCR methods are described in U.S. Pat. No. 4,683,195; U.S. Pat. No. 4,683,202; Saiki et al., Science 230:1350-1354 (1985); Innis et al., PCR Protocols: A Guide to Methods and Applications, Academic Press, Inc., San Diego, Calif. (1990).

Figure 2:
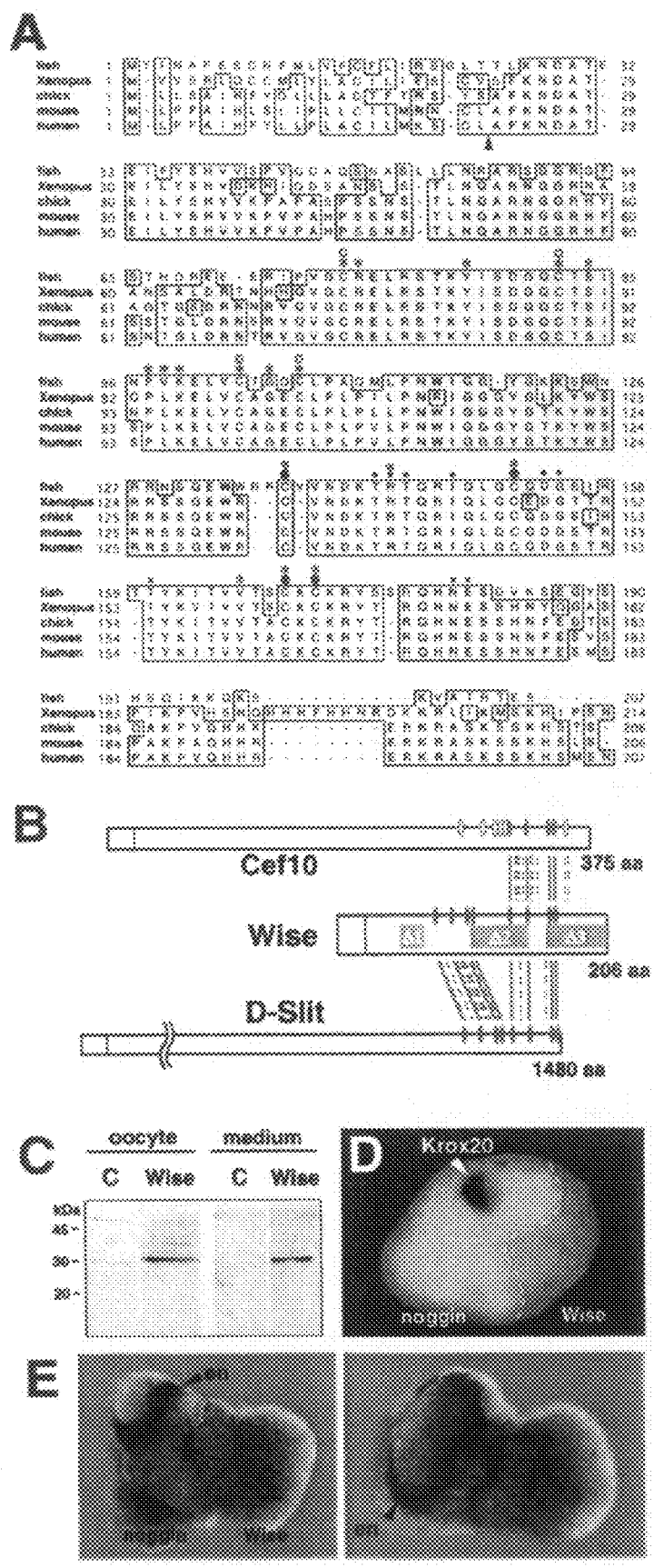
FIG. 2 shows Wise as a conserved secreted protein.

The predicted amino acid sequence of XWise-A was used for comparison with other species which are listed in FIG. 2A, which shows Wise as a conserved secreted protein. Various EST databases were searched, with the predicted amino acid sequences then aligned in FIG. 2A. The predicted amino acid sequence of Zebrafish, Xenopus, chick, mouse, and human Wise proteins were compared.

The predicted Wise protein, SEQ ID NO 45, consists of 206 amino acids and contains cysteine knot-like domains. These cysteine knot domains are found in a number of growth factors, as well as in Slit, Mucin, and CCN (Cef10/Cyr61, CTGF and Nov) family members (Bork, 1993). Among these, the C-terminal domain of the CCN family members showed the highest homology to Wise, but other motifs conserved within the CCN family were absent in Wise (FIG. 2B). Hence, Wise is related to, but not a member of, the CCN family. A homology search revealed that Wise showed the highest amino acid identity (38%) to Sclerostin (Sost), identified by positional cloning of the gene mutated in sclerosteosis (Brunkow et al., 2001).

Wise was further analyzed, as shown in FIG. 2B. The shaded boxes in FIG. 2B indicate three blocks ($\Delta 1$, $\Delta 2$, $\Delta 3$) deleted separately for functional analysis. This was done to investigate if the conserved regions were required for functional activity of Wise, three separate deletions were generated, and their ability to induce En2 expression in Noggin-injected animal caps was tested. The variant that deleted 19 amino acids outside of the CT domain ($\Delta 1$) retained the ability to induce En2. In contrast, two deletions corresponding to different parts of the Slit homology domain ($\Delta 2$ and $\Delta 3$) abolished the ability of Wise to induce En2, demonstrating that these regions were necessary for Wise function.

Example 3

A signal sequence motif is present at the N-terminus of Wise, and its secretion was confirmed by Western blotting following expression of an HA-tagged version of the protein in Xenopus oocytes (FIG. 2C) and COS cells. More particularly, Wise was injected in an amount equal to 30 ng/embryo. Western blot analysis detected HA-tagged Wise protein secreted into the medium following RNA injection into oocytes. FIG. 2C, related to the control of uninjected oocytes. Secretion of Wise was confirmed by expression of an HA-tagged version of the protein in Xenopus oocytes and COS cells. The protein was detected in both cell extracts and the culture medium (FIG. 2C). It was observed that Wise encoded a signal sequence motif at its N-terminus, suggesting that the protein is secreted.

Further, the ability of Wise to posteriorize neural tissue in a cell non-autonomous manner was tested by using a tissue recombination assay in which a Wise-expressing animal cap was combined with a noggin-expressing animal cap. It was found that both En2 and Krox20 were induced in discrete domains in the Noggin caps (FIGS. 2D and 2E). Noggin was injected in an amount equal to 500 pg and Wise equal to 600 pg. Hence, it was determined Wise has the ability to induce posterior markers at a distance.

Subsequently, the ability of Wise to posteriorize tissues in a cell non-autonomous manner was tested. Recombination between Noggin-expressing and Wise-expressing animal caps were assayed for expression of Krox20 or En2, FIGS. 2D and 2E respectively. Wise induced a ring of En2 (en) expression or patches of Krox20 staining in a non-cell autonomous manner in the Noggin cap. In FIG. 2D, the Noggin injected cap was marked with FIDx, and in 2E, the Wise cap was marked with lacZ as lineage tracers. Using a tissue recombination assay in which a Wise-expressing animal cap was recombined with a Noggin expressing animal cap, it was found that both En2 and Krox20 were induced in the Noggin caps (FIGS. 2D and 2E). As such, it was determined that Wise has the ability to induce posterior markers at a distance through the induction of Wnt.

Example 4

The following Example analyzes the expression of Wise in chick and Xenopus embryos. Whole mount in situ hybridization analysis and sections in stage 9-12 chick embryos revealed that Wise was expressed in a dynamic manner in the surface ectoderm (FIGS. 3A-3D). Expression was detectable first at stage 9. Expression was localized in the posterior surface ectoderm overlying the presomitic mesoderm, wherein somites were formed by stage 10-11 (FIGS. 3A, 3B, and 3D). FIGS. 3A-3D show in situ hybridization of chick embryos. Wise was expressed in the surface ectoderm from the level of presomitic mesoderm to the posterior end at stage 10, FIG. 3A. Higher transcript levels are detected at stage 11, FIG. 3B, which refine to a small posterior domain by stage 12, FIG. 3C. This is shown by the red stain in the FIG. 6. A section shown in FIG. 3D, in the vicinity of Hensen's node, showed Wise transcripts confined to the surface ectoderm (se). This is shown by the arrow. Expression decreased rapidly during stages 12-13, and resolved into a small posterior domain (FIG. 3D). This expression profile suggested that the original Wise cDNA was derived from the ectodermal part of the tissue used to make the library (FIG. 1A).

In an RNase protection assay, *Xenopus* Wise expression was weakly detected initially at gastrula stages (stage 10), and expression persisted into tadpole stages (FIG. 3E). FIG. 3E shows an RNase protection assay of *Xenopus* embryos with stages noted above each lane. Wise is first detected at an early gastrula stage, persisting into tadpole stages. ODC was a loading control. In later stage chick embryos, Wise was expressed in branchial arches and other specialized tissues, including feather buds. A similar pattern was observed in *Xenopus* embryos. Wise was expressed in the surface ectoderm, but had a broader domain along the A-P axis, in comparison to chick (FIG. 3F). FIGS. 3F and 3G show the whole mount in situ hybridization to *Xenopus* embryos. At stage 15 (FIG. 3F), Wise is expressed in the surface ectoderm at all anterior-posterior levels. The expression is strongest at the edge of the neural tube. At tadpole stages (FIG. 3G, stage 40), expression was localized in epibranchial placodes, lateral lines, and along the dorsal fin.

This data showed that Wise caused posterior development. It also showed the stages of development when Wise had the strongest effect.

Example 5

Figure 4:
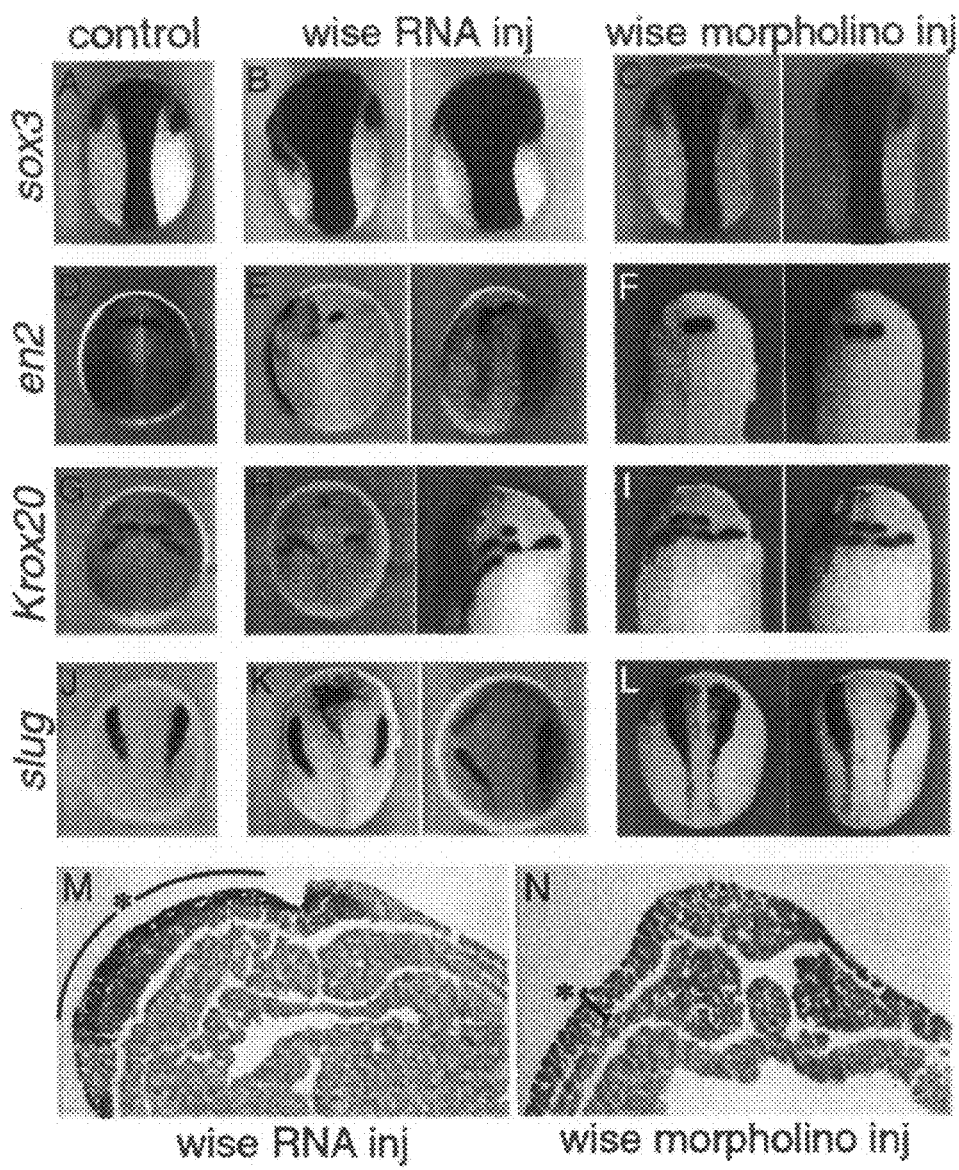
FIG. 4 shows changes in neuronal markers after blastomere injection of Wise RNA and Wise antisense morpholino oligos.

The present Example relates to changes observed in neuronal markers after blastomer injections of Wise RNA and Wise antisense morpholino oligos (FIG. 4).

Morpholino antisense oligos were designed against the beginning of the coding region of *Xenopus* Wise-A and B. The sequences were: A (SEQ ID NO 131), 5'-AGCACTG-GAGCCTTGAGACAACCAT-3'; B (SEQ ID NO 132), 5'-AGCAGTGAAGCCTTGAGACAACCAT-3'. A 1:1 mixture of these oligos was diluted in PIPES (5 mM) buffered water and used for injection. In vitro translation of Wise RNA was inhibited at oligo concentrations of between 1-10 μM, which is equivalent to injecting 6-60 ng into one *Xenopus* embryo (1.2 mm diameter). For whole embryos, 30-60 ng of morpholino was injected, and for blastomeres (animal-dorsal or animal-ventral blastomere to target the surface extoderm) 13-33 ng was injected.

FIG. 4 shows changes in neuronal markers after blastomere injection of Wise RNA and Wise antisense morpholino oligos (FIGS. 4A-L). In situ hybridization with neural markers in stage 16-21 *Xenopus* embryos following single blastomere injections of Wise RNA (FIGS. 4B, 4E, 4H, and 4K) at the 8-cell stage and antisense morpholino oligos (FIGS. 4C, 4F, 4I, and 4L) at the 4-cell stage are shown. The left panels (FIGS. 4A, 4D, 4G, and 4J) indicate control embryos. In most embryos, lacZ (blue staining) was co-injected as a lineage tracer. Injected sides were to the left. Probes were Sox3 (FIGS. 4A-4C), En2 (FIGS. 4D-4F), Krox20 (FIGS. 4G-4I), and Slug (FIGS. 4J-4L). In Wise RNA injected embryos, the neural markers were generally displaced posteriorly. Ectopic induction of Krox20 and Slug can be seen in the forebrain region (FIGS. 4H and 4K). In embryos injected with antisense morpholino oligos, these markers were unchanged.

FIGS. 4M and 4N show the transverse sections at stage 16 after blastomere injection of either Wise RNA (FIG. 4M) or Wise antisense morpholino oligo (FIG. 4N). In FIG. 4M, the neural plate on the injected side was greatly expanded, which is revealed by Sox3 staining (dark blue, *). Conversely, in the morpholino oligo-injected embryo (FIG. 4N), the surface ectoderm is thicker on the injected side (left, *) in comparison to the right control side.

To further evaluate the effects of Wise on development of the neural tube, RNA or DNA was injected into specific blastomeres at 4-16 cell stages. When Wise RNA injections were targeted to presumptive neural regions, expression of pan-neural markers (Sox3, NCAM) confirmed an expansion of the neural plate (FIGS. 4B and 4M). A-P specific markers (En2, Krox20, and Slug) were generally displaced laterally and posteriorly and were frequently expanded (FIGS. 4E, 4H, and 4K).

Identical results were obtained using DNA constructs for injection, where Wise expression commenced at mid-blastula stages under the control of a cytoskeletal actin promoter. Together, these changes in morphology and neural patterning demonstrated that ectopic expression of Wise disturbed extension and closure of the developing neural tube.

The disruption of neural tube morphogenesis made it difficult to assay for posteriorizing influences in whole embryos. However, when Wise injected cells were targeted to the forebrain region, ectopic expression of Slug and Krox20 was observed (FIGS. 4H and 4K). This indicated that anterior forebrain cells acquired a more posterior character in response to Wise.

Localized injection of the morpholino oligo resulted in embryos developing with thickened ectoderm, which contrasted with Wise RNA injections where embryos developed with a thickened neural plate (FIGS. 4M and 4N). Neural markers, such as Sox3, En2, Krox20, and Slug, were not obviously affected at early neural stages (FIGS. 4C, 4F, 4I, and 4L). This verifies that Wise and Wise mutants influence A-P patterning.

Example 6

Like Example 5, Wise RNA and morpholinos were injected into embryos. Injection of Wise RNA and morpholino oligos were observed to impact neural markers. Anterior defects after blastomere injection of Wise RNA or morpholino oligo were observed. Defects in anterior patterning, including a failure in eye formation, were observed at tailbud stages (FIG. 5H). Furthermore, expression of the cement gland marker XCG was specifically down-regulated in cells expressing Wise (FIGS. 5B and 5E). Conversely, when Wise injected cells were distributed more ventrally, the ectopic induction of the cement gland and XCG expression was observed (FIG. 5B). Therefore, ectopic expression of Wise altered aspects of A-P patterning in embryos, as well as animal caps.

FIGS. 5A-5L shows in situ hybridization with the cement gland marker XCG at stage 16-20 (FIGS. 5A-5C) and morphological phenotypes of cement gland at stage 26-40 (FIGS. 5D-5F). Hybridization with the eye at stage 35-36 is shown at FIGS. 5G-5I. The controls are shown in FIGS. 5A, 5D, and 5G. Blue staining shows co-injected lacZ lineage tracer. Over-expression of Wise resulted in formation of larger cement glands (FIG. 5C). Eye formation is consistently blocked by injection of both Wise RNA (FIG. 5H) and the morpholino oligo (FIG. 5I).

To analyze the endogenous role of Wise in embryogenesis, the *Xenopus* cognate was isolated and used to design morpholino antisense oligonucleotides, which would specifically interfere with translation of Wise RNA. In vitro translation of Wise was blocked by the morpholino oligo, whereas a control oligo had no effect (FIG. 5J). FIG. 5J shows in vitro translation of Wise in the presence of the Wise morpholino antisense oligo. Lane 1 shows translation of Wise protein without morpholino oligo. Lanes 2-7 show translation in the presence of the Wise morpholino oligo at concentrations of 0.1 nM, 1 nM, 10 nM, 100 nM, 1 μM, 10 μM, respectively. Lane 8 shows translation in the presence of control morpholino oligo at the concentration of 10 μM. Wise translation is partially blocked at concentration of 1 μM, and completely blocked at 10 μM.

When the morpholino oligo was injected into the whole embryo at the 1 cell stage, embryos developed cyclopic eyes (FIGS. 5L-5N), and the trunk and tail were shortened in most cases (FIGS. 5F and 5L). At later stages, morpholino-injected embryos showed defects in eye formation (FIG. 5I), which were rescued by co-injection of Wise RNA (FIG. 5K). FIG. 5K shows the rescue of the eye defect resulting from injection of the morpholino oligos by co-injection of Wise RNA.

FIGS. 5L-5N are the phenotypes of embryos following injection of Wise morpholino oligos throughout the whole embryo. FIG. 5L shows the range of cyclopic eye and short trunk phenotypes induced by the oligos in comparison to the control embryo (left). Section of control (FIG. 5M) and morpholino-injected (FIG. 5N) embryos at the level of eye are shown. In the Wise morpholino-injected embryos, eyes are positioned very close to the neural tube.

These results suggest that the endogenous role of Wise is to mediate elongation of the trunk, morphogenesis of the ectoderm/neuroectoderm, and formation of the eye. The fact that both ectopic expression of Wise, and inhibiting its function by injection of the antisense morpholino oligo resulted in similar defects in eye formation, suggests that this process requires a precise level of signaling, mediated by Wise.

Example 7

The present Example relates to the immunoprecipitation procedures previously discussed. To test protein secretion, RNA encoding the HA tagged version of Wise was synthesized and injected into *Xenopus* oocytes. This HA tagged Wise construct was confirmed to be functional by testing its ability to induce En2 in Noggin-injected animal caps. Fifteen oocytes were incubated in 96-well dish with 150 μl of OR2 medium+0.01% BSA for 2 days. Oocytes and the conditioned medium were collected separately and used for Western blotting with an anti-HA antibody (Boehringer). This construct was also transfected into COS cells and assayed for secretion by Western blotting.

For protein interaction studies, COS cells were transfected with DNA constructs encoding tagged versions of the proteins. Cells were harvested and proteins were extracted in 150 mM NaCl, 1% NP40, 0.5% Sodium Deoxycholate, 0.1% SDS, 50 mM Tris-HCl (pH8), a cocktail of protease inhibitors (Complete, Boehringer), and 1 mM AEBSF at 4° C. Small aliquots were kept as cell extracts for checking expression of each protein. Primary antibodies against the epitope and Protein A-coupled beads were added to the extracts, incubated for 2 hours, and collected by centrifugation. Following several rounds of washing, pellets were re-suspended in loading buffer in the presence of SDS and subjected to electrophoresis and Western blotting. The proteins were detected by using the epitope-specific antibodies and appropriate secondary antibodies conjugated to alkaline phosphatase.

Example 8

Figure 3:
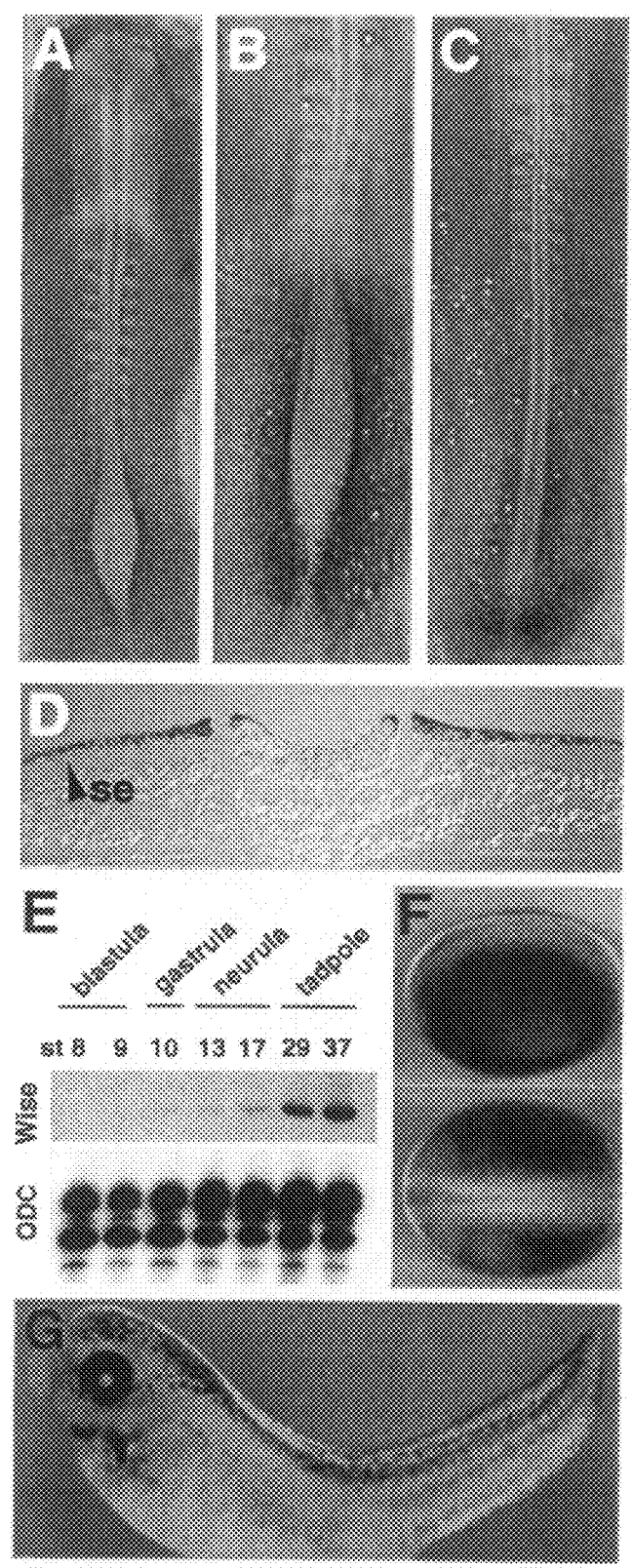
FIG. 3 shows the expression of Wise in chick and Xenopus embryos.

The ability of Wise to interact with the Wnt pathway, and the fact that it is normally expressed in a transient manner in the non-neural surface ectoderm, suggest that it might have a role in modulating Wnt signaling in this tissue (FIG. 3). A balance between Wnt and BMP signaling in the surface ectoderm and dorsal neural tube is important in modulating dorsal fates and the generation of neural crest cells. Furthermore, Wnts in the surface ectoderm influence patterning of the underlying somites and their derivatives. The distribution and timing of Wise expression in the surface ectoderm, together with the result of morpholino experiments, suggest that it promotes precise levels of Wnt signaling to control some of these interactions.

FIGS. 6A-6C show RT-PCR of Noggin treated animal caps assayed for En2 (en) induction. NCAM is used as a pan neural marker and Ef1a is a loading control. FIG. 6A shows the induction of En2 by Wnt8 or Wise RNA is blocked by dominant-negative (dn) Frizzled 8 (ΔFz8). Noggin was added in an amount equal to (500 pg); Wnt8 was (50 pg); Wise was (1.2 ng); and ΔFz8 (2 ng). In FIG. 6B, the following constituents were added: Noggin (500 pg); Wise (600 pg); ΔWnt8 (200 pg); ΔDsh(dd1) (1.2 ng); GSK3 (500 pg); and LEFΔN (200 pg). FIG. 6B shows the induction of En2 is blocked by dn-Wnt8 (ΔWnt8), dn-dishevelled (ΔDsh(dd1)), GSK3 and dn-Lef1 (LEFΔN). FIG. 6C shows the induction of En2 requires signaling components of the canonical Wnt pathway but not the planar cell polarity (PCP) pathway. Wise-mediated En2 induction was abolished by ΔDsh(dd1), a dominant negative form of Dishevelled for both pathways, and ΔDsh(DIX), which blocks the canonical pathway. ΔDsh(DEP) blocks the PCP pathway but has no effect on Wise induction of En2. ΔDsh(ΔN) specifically activates the PCP pathway but fails to induce En2 in the absence of Wise, although full length d Dishevelled (Dsh) is able to do so. In FIG. 6C, the following constituents were added: Noggin (500 pg); Wise (1.2 ng); Dsh (1 ng); and ΔDsh(d1), ΔDsh(DIX) and ΔDsh(DEP) (2.0 ng). FIGS. 6D-6G: TCF3 (300 pg); Wnt8 (25 pg); Wise (300 pg); and β-catenin (100 pg) were added in the listed amounts.

FIGS. 6D-6G show staining for sub-cellular localization of endogenous β-catenin detected immunocytochemically in *Xenopus* animal caps following RNA injection of: D, TCF3; E, Wnt8+TCF3; F, Wise+TCF3; and G, β-catenin+TCF3. Wnt8 (E) and Wise (F) promoted accumulation of nuclear β-catenin.

Wise activated the Wnt signaling pathway in animal caps. Since Wnts and Wise both induced En2 expression in Noggin-injected animal caps, whether Wise required Wnt signaling for its activity was investigated. To test, Wise RNA was co-injected with either wild-type GSK3β or dominant negative (dn) versions of the canonical Wnt pathway components, Wnt8, Frizzled, Dishevelled or Lef1. All of these Wnt blocking reagents eliminated the ability of Wise to induce En2 in neuralized animal caps (FIGS. 6A and 6B). The finding that dn-Wnt8 and dn-Frizzled8 blocked Wise activity implied that it may use the same receptor(s) as Wnt. With respect to the intracellular components, Dishevelled (Dsh) is an important branch point in Wnt signaling that separates the canonical nuclear pathway from a planar cell polarity (PCP) pathway. Different truncated dishevelled constructs were used to examine the roles of the different pathways in En2 induction. Both ΔDsh (dd1), which lacks a part of the PDZ domain necessary for both the canonical pathway and the PCP pathway, and ΔDsh (DIX), which is a specific dominant negative form for the canonical pathway, abolished En2 induction by Wise (FIGS. 6B and 6C). In contrast, both ΔDsh(DEP), which specifically blocks the PCP pathway, and ΔDsh (ΔN) which constitutively activates the PCP pathway, had no effect on En2 induction (FIG. 6C). These results suggested that the domains of Dsh, critical for the canonical Wnt signaling pathway, are essential for Wise function.

Example 9

This Example demonstrates that expression of Wise interferes with Wnt signaling. Although induction of En2 can be explained in terms of activation of Wnt signaling, the effects of injected Wise RNA on cement gland formation (FIG. 5B)

resemble those seen when the Wnt pathway is inhibited. Therefore, it is possible that Wise also inhibits Wnt signaling. As such, Wise's ability to antagonize Wnt8 activity in axial induction was examined.

In particular, FIGS. 7A-7C show the secondary axes induced by Wnt8 are blocked by Wise. Injection of Wnt8 RNA into a ventral vegetal blastomere of 4-8-cell stage embryos induced complete secondary axis formation (FIG. 7A). Co-injecting Wise blocked formation of Wnt8-induced secondary axis (FIG. 7B), similar to co-injection of a dominant negative Dishevelled, ΔDsh(DIX) (FIG. 7C).

FIGS. 7A-7C show Wnt8 (5 pg); Wise (200 pg); and ΔDsh (DIX) (1 ng) that were added in the listed amounts. In FIG. 7D Wise (1 ng); Wnt8 (100 pg); Dsh (1 ng); and β-catenin (200 pg) were added in the listed amounts.

When Wnt8 RNA was injected into a ventral vegetal blastomere at 4-8 cell stages, it induced an ectopic secondary axis. Co-injection of Wise RNA completely blocked Wnt8-induced secondary axis. This inhibition was comparable to that mediated by a dominant negative form of Dsh (FIG. 7C).

FIG. 7D shows that Wise functions extracellularly to block induction of Siamois and Xnr3 by the Wnt pathway in ventral marginal zones. Wise blocks the ability of Wnt8 to induce Siamois and Xnr3, but it does not interfere with the ability of Dishevelled (Dsh) or β-catenin (β-cat) to induce these markers.

This inhibitory activity was examined at the molecular level in ventral marginal zone explants by assaying for Wnt-dependent induction of Xnr3 and Siamois, two immediate early response genes. In agreement with the axial duplication assays, the induction of Xnr3 and Siamois in ventral marginal zones by Wnt8 was blocked by the co-injection of Wise (FIG. 7D). However, Wise had no effect on the ability of injected intracellular components, such as Dishevelled and β-catenin to induce Xnr3 and Siamois (FIG. 7D). This suggests that Wise functions extracellularly to interfere with canonical Wnt signaling.

Example 10

The inhibitory effect of Wise on the Wnt pathway was further examined by assaying secondary head induction dependent upon simultaneously blocking both BMP and Wnt signaling. When BMP signaling is blocked at the ventral marginal zone by a truncated BMP receptor (tBR), an incomplete secondary axis is formed (FIG. 7E). However, simultaneous inhibition of both BMP and Wnt signaling resulted in the formation of a complete secondary axis with eyes and cement glands. Co-injection of tBR and Wise induced a complete secondary axis (FIG. 7F), demonstrating that Wise blocked the Wnt pathway in this context.

Wise affected planar cell polarity. While the activation and inhibition properties of Wise in animal caps and embryos, described above, are dependent upon the canonical Wnt pathway, it is possible that Wise also influences the PCP pathway that branches at Dishevelled. Wnt11 is required for proper convergent extension movements of mesoderm during gastrulation in frogs and fish, and this has been shown to be dependent upon the PCP pathway of Wnt signaling. Animal caps cultured in the presence of Activin form mesoderm and undergo convergent extension movements, which can be blocked by reagents that either elevate or decrease Wnt signaling. This implies that precise levels of Wnt signaling through the PCP pathway are essential for coordinated cell movements. FIGS. 7E and 7F show that Wise acted as Wnt inhibitor and induced head attribute formation in an incomplete secondary axis system. When BMP signaling was blocked at the ventral marginal zone by injection of a truncated BMP receptor (tBR), an incomplete secondary axis was formed (FIG. 7E). Co-injection of tBR and Wise induced a complete secondary axis with eyes (arrows) and cement gland (FIG. 7F).

FIGS. 7G-7I show how Wise blocks cell movements in Activin-treated animal caps. Control animal caps (FIG. 7G) undergo gastrulation-like movements in the presence of Activin (FIG. 7H). In Wise injected animal caps, elongation was blocked (FIG. 7I), but mesoderm induction occurred. In this animal cap assay, injection of Wise RNA blocked cell movements preventing elongation of animal caps, but had no effect on Activin-induced mesoderm formation (FIGS. 7G-7I). This suggested that Wise influenced the Wnt-dependent PCP pathway, but whether activation or inhibition of the pathway resulted, cannot be distinguished. This effect on cell behavior in animal caps is consistent with and may explain the phenotypic effects observed in Wise-injected whole embryos. Wise perturbed the morphogenesis of the neural tube, which failed to close. It was thickened and shorter, and there was a lateral expansion and broadening of A-P markers. Many of these defects appear related to abnormal convergent extension movements during gastrulation. However, the fact that morpholino antisense oligo does not interfere the neural A-P markers (FIG. 4), and that Wise is not predominantly expressed at gastrula state (FIG. 2), both suggest that endogenous Wise is unlikely to be involved in gastrulation movement. Instead, Wise has a potential to interfere with the Wnt-mediated PCP pathway.

Example 11

Figure 8:
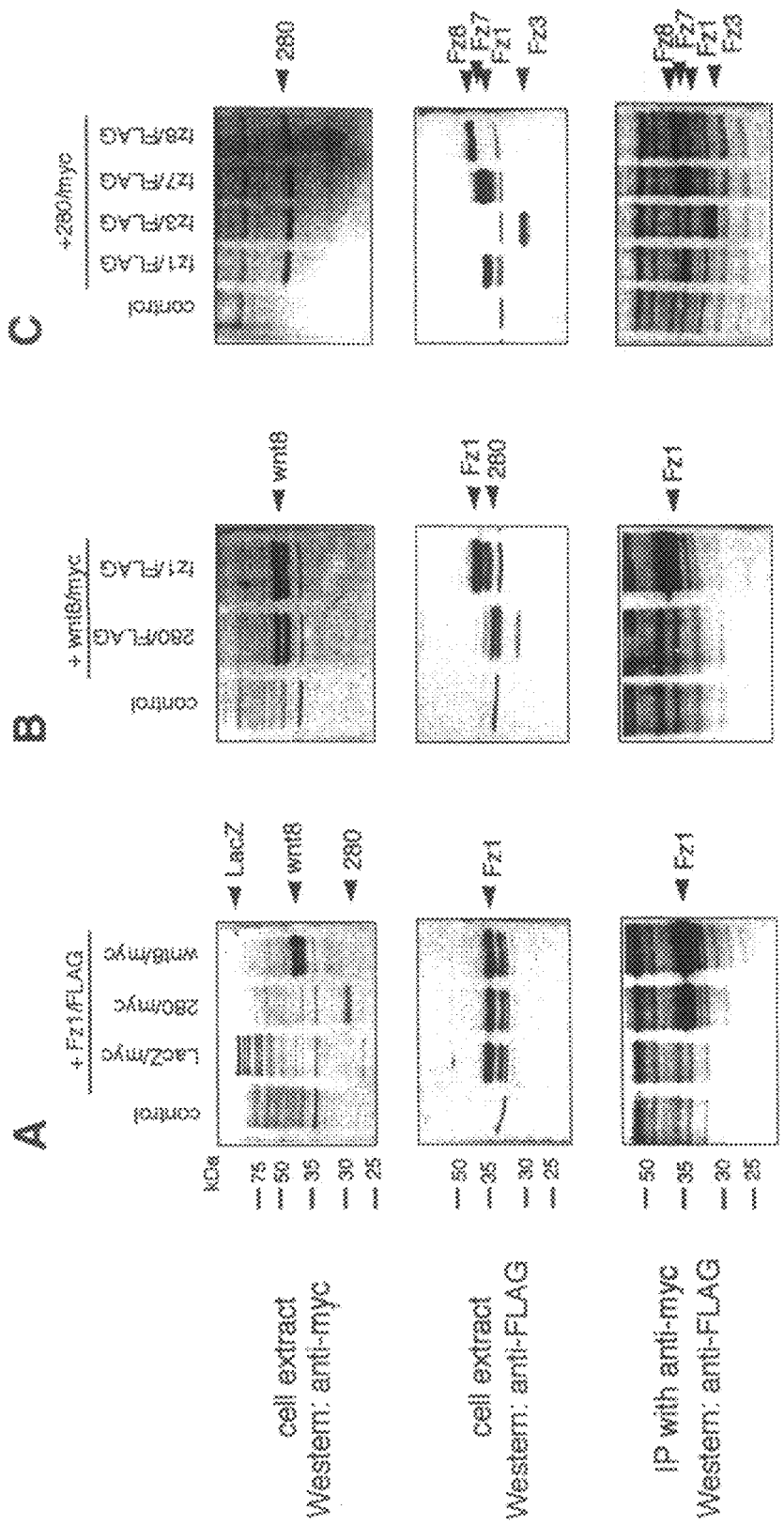
FIG. 8 shows that Wise interacts with the extracellular domain of Frizzled 1, 3, 7, 8; and Western blotting of COS cell extracts from cells transfected with epitope tagged protein variants. The relevant constructs transfected into COS cells that were used to prepare each extract are listed at the top of each column.

The mechanisms of action were investigated as potential physical interactions of Wise, with Wnt family members or their putative co-receptors Frizzled (Hsieh et al., 1999) and LRP6 (Tamai et al., 2000) or Frizzled8 (Hsieh et al., 1999) with Wise conditioned medium, and assayed for interactions by immunoprecipitation (IP). In this assay, Wise bound to LRP6 and Frizzled 8, but not to Wnt8 (FIG. 8). Recent studies have shown that individual members of the Dickkopf (Dkk) family of secreted proteins can either antagonize or stimulate Wnt signaling through interaction with LRP6 (Brott and Sokol, 2002; Mao et al., 2001; Wu et al., 2000). Therefore, IP experiments were performed to determine if Wise shared common binding sites with Dkk1 or Wnt on LRP6. The extracellular domain of LRP6 contains four EGF repeats and Dkk1 interacts with repeats 3-4, while Wnt interactions seem to involve repeats 1-2 (Mao et al., 2001). It was found that Wise binds to LRP6 and a variant where EGF repeats 3 and 4 are deleted (ΔE3-4), but not to one in which EGF repeats 1 and 2 are removed (ΔE1-2) (FIG. 8A). Conversely, Dkk1 binds to LRP and ΔE1-2, but not to ΔE3-4 (FIG. 8A). These results showed that Wise shared the domain on LRP6 essential for interaction with Wnt and that Wise and Dkk1 modulate LRP6 activity by interacting through different domains. Wise and Wnt8 were tested to determine whether they could bind to LRP6 at the same time, or whether they compete for binding. As shown in FIG. 8C, Wise interferes with the binding of Wnt8 to LRP6. This suggested a mechanism, whereby Wise inhibits Wnt signaling by competing with Wnt8 for binding to LRP6 (FIG. 8D).

In conclusion, the results demonstrate that Wise influenced both the canonical and PCP pathways of the LRP/Wnt signaling cascade. The novel ability to both activate and inhibit Wnt signaling through actions of a single discrete regulatory molecule, places Wise in a unique position as a modulator of Wnt signaling.

Example 12

In this Example, Sost inhibition of the Wnt pathway is described. It has been demonstrated that Wise acts to inhibit the Wnt pathway. The functional inhibition of Wnt was shown to be derived from the second exon of Wise, which encodes the cysteine knot. Since the cysteine knot of Sost is 70% homologous to that of Wise (FIG. 9), thus Sost's potential functioning in a similar fashion was explored. Sost RNA was either microinjected alone or in combination with other factors into Xenopus embryos and dorsal marginal zones were assayed for early immediate Wnt response genes, Siamois and Xnr3 (FIG. 11). It was found that, like Wise, Sost was able to inhibit the action of Wnt on Siamois and Xnr3 (FIG. 11). This Wnt inhibition by Sost was found to be working upstream from β-Catenin (FIG. 11). Like Wise, Sost was able to rescue secondary axis formation by Wnt (FIG. 11). However, unlike Wise, Sost was unable to completely restore a normal axis (FIG. 11).

Wise has also been shown to induce En2 at a distance in Xenopus Noggin animal cap assays. En2 expression at a distance is from an induction of Wnt gene activity. The conclusion was that Wise had induced, at a distance, more posterior neural markers in an anterior neuralized animal cap. Next it was analyzed whether Sost and Wise could be redundant by looking to see if Sost could also induce En2, like Wise. Xenopus embryos were either injected with Noggin and/or with Sost or Wise. We found that Wise injected animal caps induced En2 expression, however Sost injected caps did not (FIG. 11). This unexpected finding led to further examination of these two genes.

Example 13

A Wise knockout mouse was made as detailed herein. A Neo-lacZ cassette, containing stop codons at the 3' end, was inserted into a Wise gDNA sequence isolated bacterial artificial chromosome (BAC) from a 129 strain of mouse by conventional cloning techniques. The mouse Wise DNA sequence is SEQ ID NO 1. A Sost knockout mouse can similarly be made. The mouse Sost sequence is SEQ ID NO 6. The Neo-lacZ cassette can be obtained from Stratagene (La Jolla, Calif.). The E. coli lacZ gene, when integrated into the mouse genome by standard cloning techniques, can be used as a reporter gene under the control of a given promoter/enhancer in a transgene expression cassette. The lacZ gene encodes β-galactosidase, which catalyzes the cleavage of lactose to form galactose and glucose. In the presence of X-gal chromogenic substrate, β-galactosidase converts the substrate into an insoluble blue dye, allowing identification of cells containing lacZ activity.

The 129 mouse strain, commonly utilized in creating "knockout" mice, was obtained from Jackson Laboratories, Bar Harbor, Me. The Wise knockout mice produced lacked the presence of functional Wise polypeptide molecules. Sost knockout mice are predicted to lack functional Sost polypeptide molecules. Thus, these knockout mice may be referred to as functional mutants. In such mutant mice, protein translation is prematurely terminated.

A Neo-lacZ cassette, containing stop codons at the 3' end, was inserted into the first Exon of the Wise DNA, isolated BAC using the SmaI and EcoRI restriction sites. However, the Neo-lacZ cassette can also be inserted into a position within or adjacent to Exon 1 (SEQ ID NO 127) and Exon 2 (SEQ ID NO 128) of Wise. The Wise-containing BAC preparation was exposed to cleavage enzymes, such as SpeI and BamHI, which yielded homologous arms containing 5' UTR and 3' intron nucleic acid sequences. These nucleic acid sequences permitted homologous recombination with wild type DNA from 129 mouse-derived embryonic stem (ES) cells upon introduction of the BACs into ES cells by the electroporation method described in Example 32. The Neo-lacZ cassette contained one or more stop codons terminating translation of Wise polypeptide, leading to production of a truncated Wise polypeptide, which lacked the cysteine knot motif. The Wise cysteine knot region is significant because this region (1) is homologous to cysteine knot regions of Sost and other family members as described herein, and (2) binds to LRP.

After recombination, the ES cells were grown in the presence of G148 for neomycin selection. Neo-lacZ cassette-containing ES cells were neomycin-resistant and positively selected. There were three possible event outcomes occurring when the resultant ES cells were cultured in neomycin-containing media: First, Wise Neo-lacZ cassette-containing ES cells grew, indicating a successful homologous recombination event within the first Exon region of Wise, as predicted. Second, no recombination occurred, resulting in the lack of the presence of a protective Neo-gene in the ES cells and cell death. Third, recombination occurred outside the first Exon of Wise, conferring neomycin resistance and ES cell survival and growth.

To distinguish between the above first and third categories of recombination events in live neomycin-resistant ES cell cultures, genomic DNA (gDNA) extracted from ES cells was divided into two aliquots. One part was frozen (−20 deg. C.) for further investigation, and the other part was digested in vitro with EcoR I for Southern Blot analysis. By using a 3' probe within Wise Exon 2, EcoR I digestion yielded either a 6.8 Kb fragment associated with a homologous recombination event, or a 9.0 Kb fragment associated with a random integration event. Frozen cultures from those plates that exhibited homologous recombination event were thawed, expanded and further processed for creation of Wise mutant mice by micro-injection of these Wise Neo-lacZ cassette-containing ES cells into blastomeres as described hereinafter.

In the process of electroporation of mouse ES cells, linearized Wise nucleic acid sequences containing the Neo-lacZ cassette were inserted into the nuclei of ES cells for incorporation into the host ES cell DNA. Similarly, Sost nucleic acid sequences with the Neo-lacZ cassette can be inserted into the nuclei of ES cells for incorporation into other host ES cell DNA. The electroporation process steps were as follows. ES cells were obtained from removed blastocysts obtained from mouse uteri and grown on mitotically inactivated Mouse Embryonic Fibroblast (MEF) feeder layers. An ES cell frozen ampoule was thawed and transferred to a sterile dish containing MEFs as a feeder layer at a concentration of $1 \times 10^6$ cells per 10 centimeter (cm) dish. ES cells were grown on the MEF feeder layer in ES media in T-150 flasks. ES cells were centrifuged and washed in transfection buffer (1×Hebs). ES cells were then placed in a sterile "flat pack" 1.8 mm gap cuvette (BTX order #485), and the cuvette was inserted between the safety stand contacts.

The power was switched to the on position with the BTX 600 or equivalent electroporator set to 500 V/capacitance and resistance, 500 uF capacitance timing, 360 ohms R8 resistance timing, and charging voltage 185V. After pipetting the ES cells up and down with a 5 ml pipette, targeting construct DNA (40 μg of clean linear DNA in 1×TE @ 1 μg/μl for each electroporation) was added to the ES cells in a microfuge tube. Cells were pipetted up and down gently with a Pasteur pipette. Cells were slowly added to the cuvette which was then placed into the electroporation chamber. The start button was pushed, and electroporation occurred. After completion, electroporated ES cells were removed from the cuvette and placed in 5.0 ml of fresh ES medium in a centrifuge tube. 2 ml of transfected ES cells were added to each dish containing inactivated MEF feeder layers. Dishes were rocked slowly to evenly disperse cells and incubated. ES cells were fed on day 9 and 12 with selection medium, and clones became visible as small nests under an inverted microscope. Clones were picked on day 13 or 14 using a pipettor set between 30 and 50 µl. Clones were each placed into one of 24 wells containing ES selection medium. On day 16 or 17, clones were frozen in ES freezing medium and stored at −70° C.

Each set of ES cells containing mutant Wise genes were injected into mouse embryos for creation of transgenic "knockout" mice. Such ES cells were microinjected into early mouse embryos (i.e., blastocysts) which were then transferred to surrogate mothers for embryonic development. Targeted stem cells containing mutant Wise were placed in an injection chamber with expanded blastocysts. Stem cells were loaded into the injection needle and inserted into the blastocoel cavity of the recipient 129 or C57BL/6 embryo, then implanted into the uterus of a foster mother. Chimeric offspring were identified by coat color (i.e., at 2 weeks) or other markers and confirmed by Southern blot analysis of tail biopsies (i.e., at 3 weeks). Similarly, ES cells containing mutant Sost genes can be made and injected into ES cells to make Sost knockout mouse embryos.

The resulting pups (i.e., chimeras) contained a (+) gene in some cells and a (−) gene in other cells. Chimeras were mated with normal mice. Pups were identified that carry one (+) and one (−) copy of the Wise gene, and these animals were mated with each other.

The mouse pups were then analyzed. About 25 percent of the pups were found to have inherited the (−) gene from both parents and completely lack the (+) or wild type gene. Homozygous (−) gene pups lacking the Wise wild type gene were termed "Wise knockout mice." Similarly, homozygous (−) gene pups lacking the Sost wild type gene can be made, and these are referred to as "Sost knockout mice." Wise knockout mice were then utilized for subsequent experiments to determine effects relating to bone mineral density, bone deposition, embryo implantation, hair development, tooth abnormalities, ophthalmic abnormalities. Sost knockout mice may similarly be made and utilized in phenotypic experiments.

Example 14

A Sost knockout mouse can be made using the procedure of Example 13 above. Briefly, a Neo-lacZ cassette, containing stop codons, can be inserted into a Sost gDNA isolated BAC from a 129 mouse strain by conventional cloning techniques. The Sost-containing BAC preparation can be electroporated and allowed to undergo homologous recombination into ES cells and be exposed to selection. ES cells containing mutant Sost can be injected into mouse embryos for creation of transgenic Sost knockout mice as previously described.

Example 15

In this Example, the Wise knockout mice, produced in Example 12, were used to investigate the effect of the absence of a functional Wise polypeptide molecule upon opthalmic development. It was determined that ophthalmic abnormalities developed in these mutant mice. Immunodetection of Wise protein production in murine retinal regions was used to determine the efficacy of induced Wise mutation in the Wise mutant mice.

Polyclonal anti-Wise peptide antibody was prepared by rabbit immunization with Wise peptide antigens. Such antibodies were directed against the cysteine knot loop encoded by Exon 2 of Wise.

Zymed FITC-conjugated secondary polyclonal antibody directed against primary rabbit anti-Wise peptide antibody was also utilized in a histological sandwich immunoassay. Eye mounts containing retinas or sections were stained with anti-Wise antibody and FITC-conjugated second antibody. In wild type mice, anti-Wise reactivity was detected as secreted Wise protein in the ganglion cell and optic fiber layers and in rods and cones. However, Wise mutant mice eyes lacked detectable anti-Wise peptide reactivity, indicating absence of Wise from tissues of these mutant mice.

Figure 12:
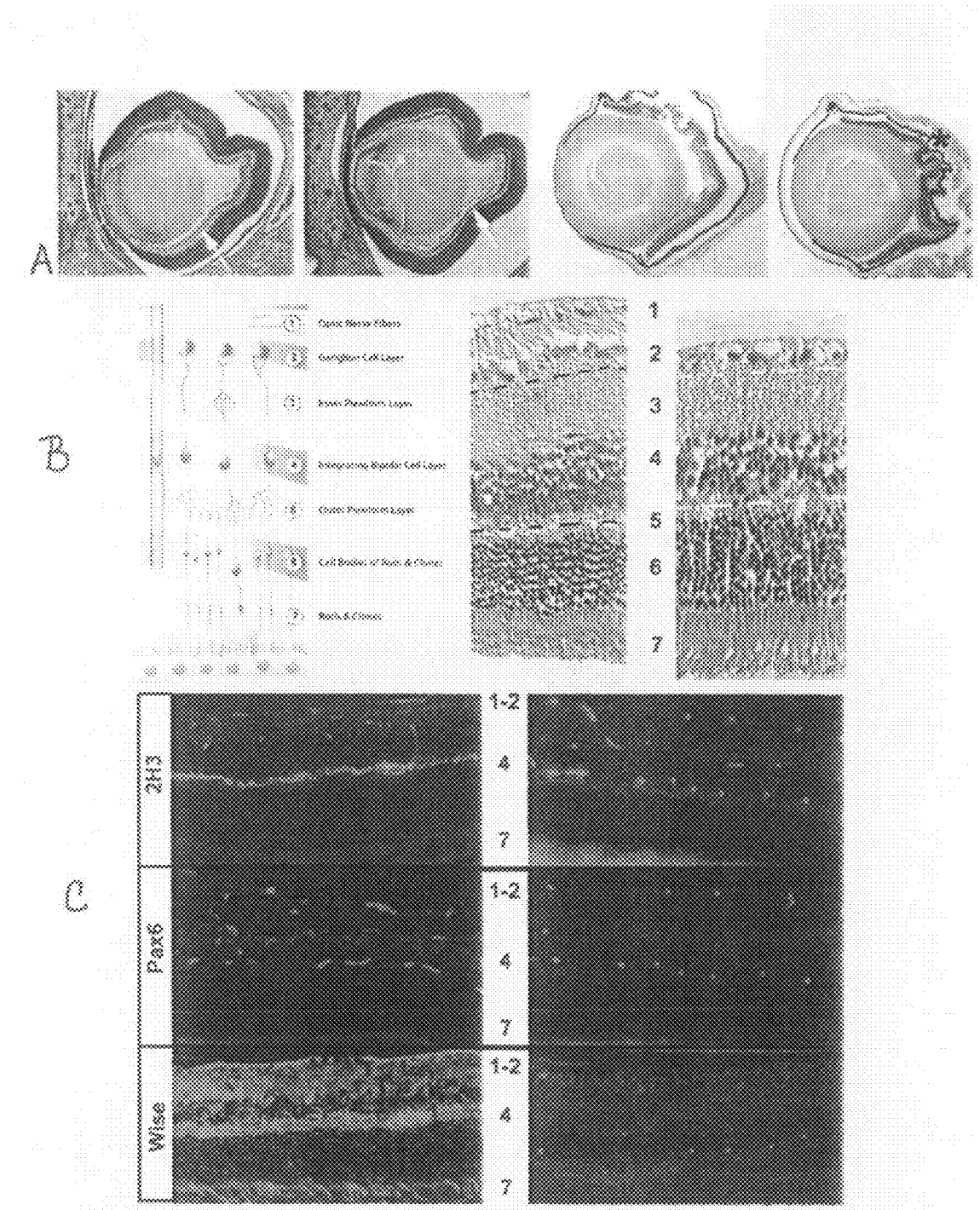
FIG. 12 shows the effect of the absence of a functional Wise polypeptide molecule upon ophthalmic development in Wise knockout mice, wherein ophthalmic and eye abnormalities developed in these mice. Immunodetection of Wise protein production in murine retinal regions was used to determine the efficacy of induced Wise mutation.

The Wise mutant mice appeared to have lost the majority of the optic nerve fibers and had increased rod and cone layers in the retina (FIG. 12). These mice also exhibited abnormal retinal ganglion cells. Wise protein was found in the inner plexiform layer, ganglion cells and fibers, and in the rods and cone layer of a 2.5 month mouse retina (FIG. 12). Unlike Wise, Sost was found in the tissues adjacent to the neuroepithelium of the diencephalon at E18 dpc.

Example 16

Wise mutants were analyzed to compare BMD in Wise mutants as compared to that in wild type mice. A Piximus instrument (Faxitron) was used to measure BMD, computed in whole mice by measurement of bone weight divided by area of bone measured.

The BMD in Wise mutants from the C57BL6 and 129 mouse strains was compared with that in wild type (wt) mice by the student t-test method. The resultant p value obtained for the BMD differences between C57BL6 vs. Wise mice was 0.0017. This indicates that BMD values increased in Wise mutant mice as compared to C57BL6 wt mice, with a significant difference between groups ($p<0.01$) observed. Increased BMD values were also observed in the 129 Wise mutant mice in comparison with 129 wt mice.

Figure 13:
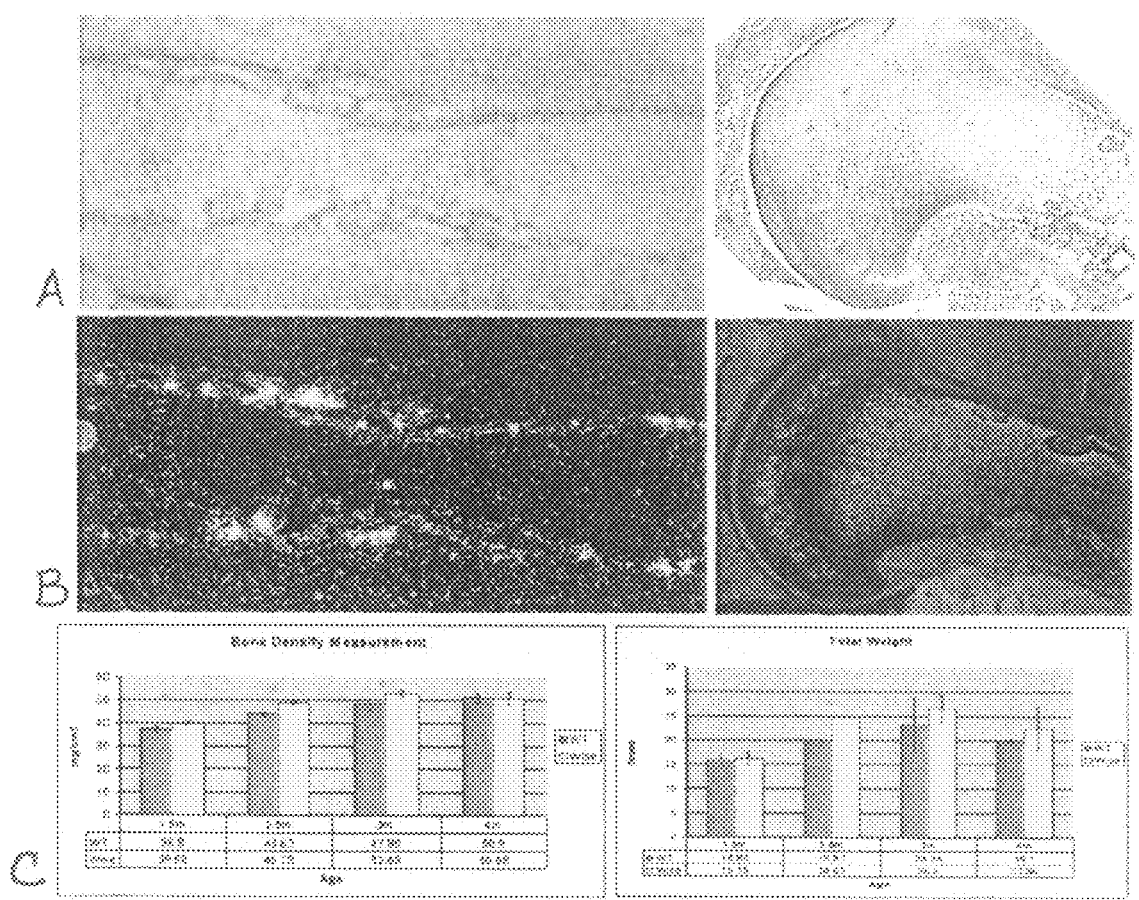
FIG. 13 shows results of bone staining and bone mineral density (BMD) measurements.

Related to this finding, FIG. 13 shows results of bone staining and BMD measurements. FIGS. 13A and 13C depict hematoxylin and eosin (H&E) staining of cross-sections of bone tissue from 16 to 18 days post cortum (DPC) mice. FIGS. 13B and 13D show the same bone regions as FIGS. 13A and 13C; however, FIG. 13B shows staining with S-35 radiolabel attached to Sost RNA probes, wherein Sost is located in osteoblasts in 16 to 18 DPC mice. FIG. 13D also shows staining with anti-Wise peptide primary antibody and FITC-conjugated secondary antibody, and localization of Wise in hypertrophic and prehypertrophic proliferating chondrocytes.

FIGS. 13E and 13F show graphical depictions of bone density measurements and total bone weight measurements, respectively. FIG. 13E shows that observable significant differences in BMD measurements between Wise mutant and wild type mice occur at ages between 0 and 3 months. Wise mutant bone is higher in density than wt bone in this age range. At 4 months, there appears to be no significant difference between mutant and wt groups. FIG. 13F depicts total bone weight measurements. Note that at 2.5 months wt bone weight is 19.87, significantly different from the Wise bone weight of 24.67. Therefore, some of the increase in BMD found at 2.5 months can be attributed to increase bone weight and not necessarily an increased BMD. Consistent with data in FIGS. 5E and 5F, it is concluded that during the 0 to 3 month period, bone deposition occurs. However, at the 4 month maturation stage, it is postulated that regulatory genes are switched on to remodel bone deposition and bone removal, wherein osteoclasts may be triggered to remove previously deposited bone.

Figure 5:
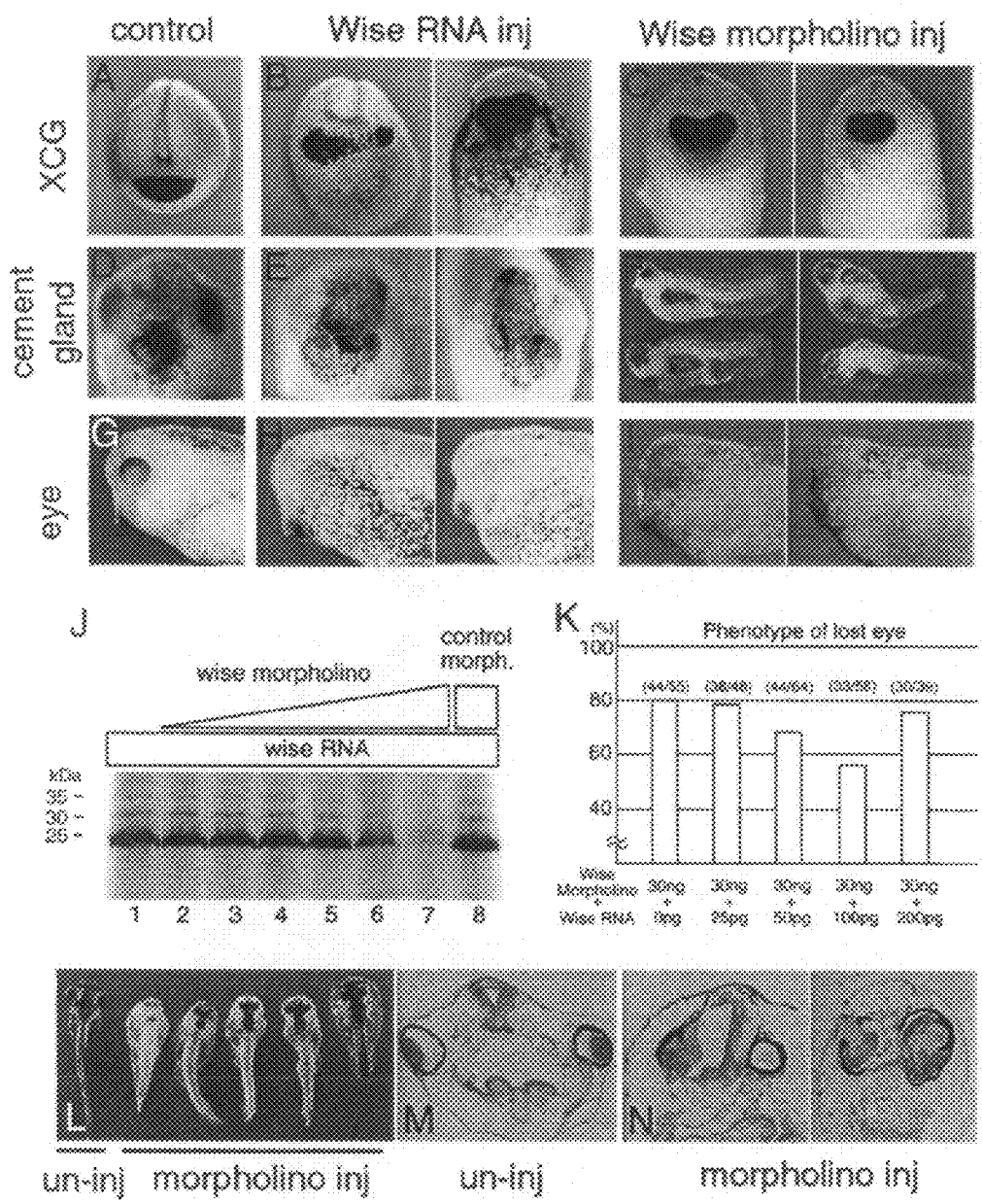
FIG. 5 shows the anterior defects after blastomere injection of Wise RNA or morpholino oligo.

In summary, one tissue cell type that both Sost and Wise genes appear to affect in a similar fashion is the bone. Sost is expressed in osteoblasts. Sost may also be expressed in osteoclasts. In contrast, Wise is expressed in periosteum, and its protein is found on chondrocytes (proliferating, prehypertrophic and hypertrophic), but not in the growth plate (FIG. 5). Yet, both Sost and Wise genes display a similar phenotype of increased bone density, albeit potentially activated at different developmental stages. As such, Wise mutant mice have increased bone density during early prenatal bone development (under 4 months), and cease to exhibit increased bone density once bone-modeling begins (4 months; FIG. 5). However, Sost mutations result in increased bone density during the subsequence developmental stage in which the adult bone remodeling process occurs.

Example 17

Figure 14:
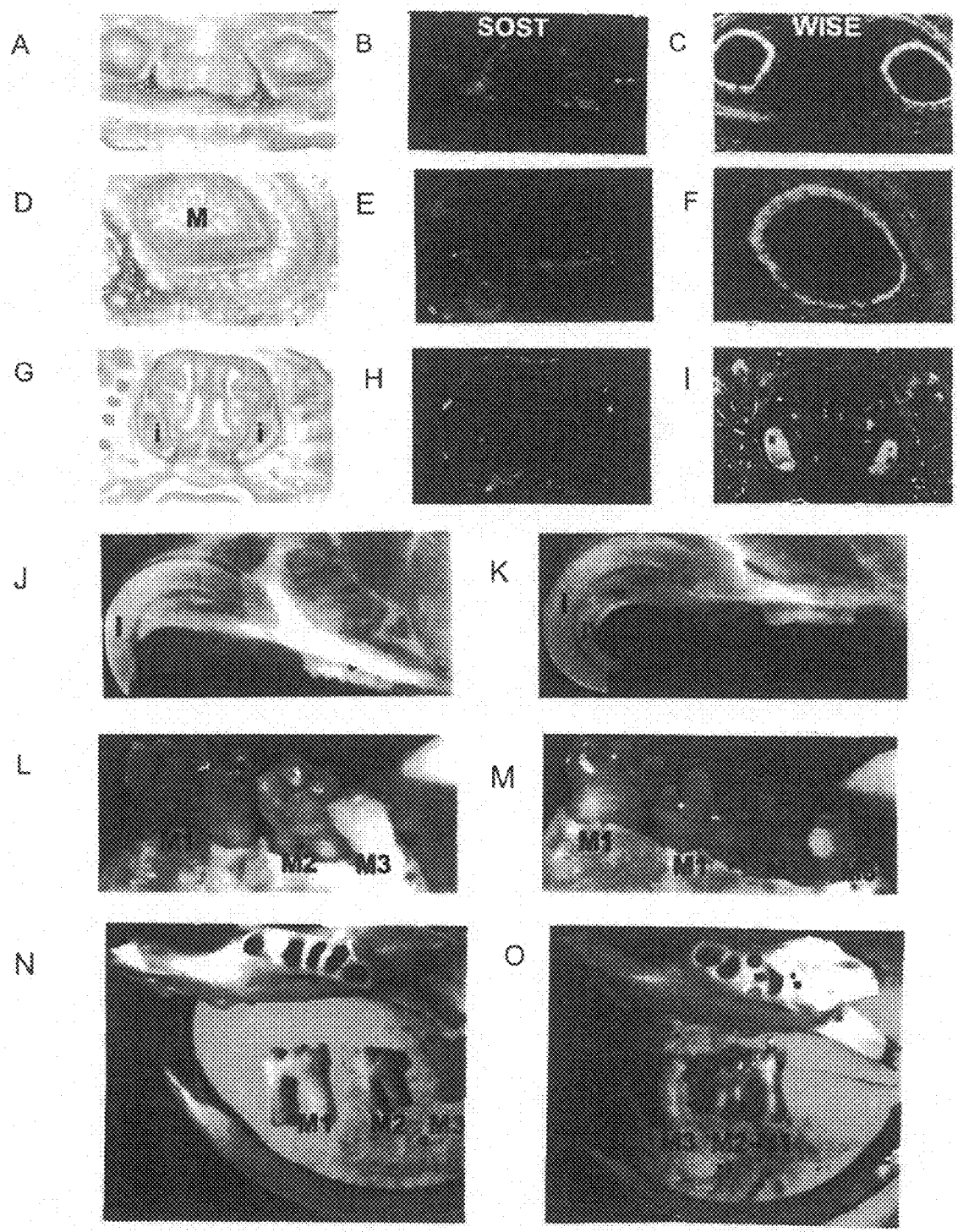
FIG. 14A shows a bilateral view of two molars with developing tooth buds on hemotoxylin and eosin staining of a tooth cross-section.
FIG. 14B shows a bilateral view of two molars with developing tooth buds with S-35 RNA probe-labeled Sost staining.
FIG. 14C shows a bilateral view of two molars with developing tooth buds stained with S-35 RNA probe-labeled Wise stain for purposes of detailing the layers of the dental follicle surrounding the molar teeth.
FIG. 14D shows a molar tooth bud at a higher magnification with a bilateral view of two molars on hematoxylin and eosin staining of a tooth cross-section.
FIG. 14E shows a molar tooth bud at a higher magnification stained with S-35 RNA probe-labeled Sost stain for purposes of detailing the osteoblasts and trabecular bone adjacent to the molar tooth.
FIG. 14F shows a molar tooth bud at a higher magnification stained with S-35 RNA probe-labeled Wise stain for purposes of detailing the dental follicle layers.
FIG. 14G shows a bilateral view of two molars on hematoxylin and eosin staining of a tooth cross-section, an incisor tooth staining patterns, and the morphological features of two incisors, with the nasal crest between them, tongue, and hair follicles of the whisker pad.
FIG. 14H shows incisor tooth staining patterns with S-35 RNA probe-labeled Sost stain for purposes of detailing the osteoblasts of trabecular bone.
FIG. 14I shows incisor tooth staining patterns with S-35 RNA probe-labeled Wise stain, prominent Wise staining of incisors, hair follicles and the whisker pad are also stained with Wise labeled RNA probes.
FIG. 14J shows X-ray photographs of incisor teeth in the maxilla (upper jaw) regions of the wild type mice, utilizing a 120 strain genetic background.
FIG. 14K shows X-ray photographs of incisor teeth in the maxilla (upper jaw) regions of the Wise mutant mice utilizing a 120 strain genetic background, the Wise mutant jaw possesses an additional incisor tooth (i') not present in the wt mouse shown in FIG. 14J, the additional tooth may orginate from either an additional tooth bud or, alternatively, from a bifurcation of the original incisor.
FIG. 14L shows the patterning in molar teeth observed in a wt mouse against a C57BL6 genetic background.
FIG. 14M shows the patterning in molar teeth observed in a Wise mutant mouse against a C57BL6 genetic background, the additional M1 molar in the Wise mutant is present compared to the M1, M2, and M3 molars present in the wt mouse in FIG. 14L.
FIG. 14N shows the patterning in molar teeth observed in a wt mouse against a 129 background.
FIG. 14O shows the patterning in molar teeth observed in a Wise mutant mouse against a 129 background, abnormalities are present compared to the wt mouse of FIG. 14N.

Genetic regulation in tooth and jaw development was examined in wild type and Wise mutant mice as shown in FIG. 14. The mice were dissected, and the jaws were placed in a proteinase K solution (2×SSC, 0.2% SDS, 10 mM EDTA, and 100 ul of 10 mg/ml proteinase K) overnight at 55° C. The next day the jaws were air-dried. A digital Faxitron was used for capturing X-ray images of the mouse jaw. The teeth were removed using tweezers.

FIGS. 14A, 14D, and 14G show hematoxylin and eosin staining of a jaw cross-section. FIGS. 14B, 14E, and 14H show S-35 RNA probe-labeled Sost staining. FIGS. 14C, 14F, and 14I show S-35 RNA probe-labeled Wise staining. Generally, these figures show that Sost appears in ondontoblasts and osteoblasts. In contrast, Wise is found in incisors, dental follicles, and hair follicles in the whisker pad.

The top sectional FIGS. 14A, 14B, and 14C show a bilateral view of two molars with developing tooth buds. FIG. 14C shows that Wise labels layers of the dental follicle of molar teeth.

The middle sectional FIGS. 14D, 14E, and 14F show a molar tooth bud at a higher magnification. FIG. 14E shows Sost staining in osteoblasts of the trabecular bone adjacent to the molar tooth. Visible staining of the odontoblasts occurs along the base of each molar. FIG. 14F shows Wise staining of dental follicle layers.

The bottom sectional FIGS. 14G, 14H, and 14I show incisor tooth staining patterns. FIG. 14G shows the morphological features of two incisors, with the nasal cleft between them, tongue, and hair follicles of the whisker pad. FIG. 14H shows Sost staining in osteoblasts of trabecular bone. FIG. 14I shows prominent Wise staining of incisors. Hair follicles and the whisker pad are also stained with Wise labeled RNA probes.

FIGS. 14J and 14K show X-ray photographs of incisor teeth in the maxilla (upper jaw) regions of the wild type and Wise mutant mice, respectively, utilizing a 129 strain genetic background. The Wise mutant jaw, shown in FIG. 14K, possesses an additional incisor tooth (i') not present in the wt mouse shown in FIG. 14J. The additional tooth may originate from either an additional tooth bud or, alternatively, from a bifurcation of the original incisor.

FIGS. 14L, 14M, 14N, and 14O show the patterning in molar teeth observed in wt (FIGS. 14L and 14N) as compared to Wise mutant mice (FIGS. 14M and 14O), against a C57BL6 genetic background (FIGS. 14L and 14M) and 129 background (FIGS. 14N and 14O). Fig. M shows an additional M1 molar in the Wise mutant mouse in comparison to the M1, M2, and M3 molars present in the wt mouse in FIG. 14L. FIG. 14O shows tooth abnormalities in the Wise mutant mouse. The M1 and M2 molar teeth are fused together. Moreover, there is a reversal of the order of molar bone patterning, wherein an M3/M2-1 pattern appears in the Wise mutant, in contrast to the wild type's M1/M2/M3 pattern. Occasionally, an additional M4 molar tooth appears in the Wise mutant.

It was observed that Wise mutant mice possessed tooth abnormalities. The incisors occurred in duplicate number in comparison with wt mice, and these teeth required weekly clipping from the weaning stage onwards. In addition, the molars also displayed abnormal patterning. The three molars were often found in reverse orientation and also showed fusion of M1 and M2. In contrast to Wise mice, Sost human mutations did not display these molar and incisor tooth phenotypic abnormalities, probably because of the differences in Sost and Wise gene expression distributions in bone. Thus, Sost was expressed in the polarized odontoblasts and the surrounding osteoblasts. Wise, on the other hand, is expressed in the dental follicle surrounding the tooth bud and in the incisors. Thus, Sost and Wise were expressed in complementary cell types, wherein differing tooth and eye phenotypic expression patterns are anticipated and observed in Sost human mutations and Wise mutants.

Example 18

Plasmid vectors containing Wise nucleic acid sequences were prepared for the purpose of producing Wise proteins and polypeptides. Sost vectors were similarly prepared for the purpose of producing Sost proteins and polypeptides. The expression vector, pET-28b (Novagen pET System Manual), was used for the expression of Wise and Sost, LRP5 and LRP6 sequences. This plasmid utilizes the phage T7φ10 gene promotor. This promotor is not recognized by *E. coli* DNA dependent RNA polymerase, and thus will not produce substantial levels of the polypeptide unless T7 RNA polymerase is present. Strain BL21 (DE3) contains a lysogenic λ phage that encodes the required polymerase under control of the lacUV5 promotor. A recombinant protein that was made was the intact Wise, Sost, LRP5 or LRP6 proteins. The Wise pET vector which was created by placing an EcoRI-HindIII fragment containing chick Wise cDNA into the pET28B vector which was then digested with EcoRI-HindIII. Extra amino acids 5' to Wise Start, ATG were removed, along with extra amino acids 3' to the Wise stop codon. The Sost pET vector was created by placing a BamHI-XhoI fragment containing mouse Sost cDNA into pET BamHI-XhoI. The amino acids from the 5' and 3' ends to the Sost coding region were removed using mutagenesis. The 3' amino acids were deleted and the missing ELENAY was inserted at the 3' end.

Example 19

In this Example, the method used for protein production for Wise, Sost, LRP5, and LRP6 polypeptides in HEK293 mammalian cells is outlined briefly. PCS2+Sost-FLAG, PCS2+Wise-FLAG, or PCS2+LRP6 IgG, PCS2+LRP5-Myc DNA was transfected into the HEK293 cells using FuGENE 6 Transfection Reagent (10 µg DNA/100 mm plate) (Roche Diagnostics Corp., Indianapolis, Ind.). The FuGENE reagent is a multi-component lipid-based transfection reagent that complexes with and transports DNA into the cell during transfection. Adherent cells were plated one day before transfection, and freshly passaged HEK293 suspension cells were prepared. FuGENE 6 reagent:DNA ratios of 3:2, 3:1 and 6:1 were used to transfect HEK293 suspension cells.

After incubation, cell supernatants, containing the polypeptide of interest (Wise, Sost, LRP5, LRP6), were collected on days 1, 2, 3, and 4. Polypeptide-containing supernatants were concentrated by Amicon Ultra-15 column passage (20 ml to 500 µl). Some aliquots were frozen, and other aliquots were used in Western blot and immunoprecipitation quantitation and characterizations using standard methodologies. Mixtures of Wise and LRP5, Wise and LRP6, Sost and LRP5, and Sost and LRP6 were analyzed for binding by immunoprecipitation and Western blot analysis. See SuperSignal West Dura Western Blotting Kit (Pierce, Rockford, Ill.), Trans-Blot SD Semi-Dry Electrophoretic Transfer and Mini-PROTEAN 3 Electrophoresis (Bio-Rad Labs., Richmond, Calif.), Hybond-P PVDF Membrane for protein transfer (Amersham Pharmacia Biotech), Chroma Spin Columns (Clontech, Palo Alto, Calif.).

Immunoprecipitation was performed with anti-Wise antibody, anti-Myc, anti-Flag, and protein G sepharose (Sigma, St. Louis, Mo.) or protein A sepharose (Repligen). Briefly, transfected cell supernatants were prepared and 1-3 µg of antibody added. After incubation, 30 µl of protein G sepharose was added, incubated, and beads were centrifuged. Beads, containing antibody from supernatants as the immunoprecipitate, were washed in buffer, then submitted to SDS-PAGE analysis and Western Blot analysis. Alternatively, immobilized antibody was used in immunoprecipitation of proteins.

In Western Blots, electrophoresis was performed upon the cell supernatant material above. After wash, water rinse, and equilibration of the PVDF membrane in transfer buffer, papers were sandwiched as follows: pre-soaked thick paper, membrane, gel, pre-soaked thick paper. Power was turned to 10V to 15V for 30 min. After transfer of protein to the HyBond-P PVDF membrane, the membrane was incubated in blocking buffer, rinsed, and incubated with antibody solution. After wash, a secondary antibody was added, washed, then ECL-plus added. After exposure of X-ray film, patterns were read. As such, protein production in PCS2+ transfected HEK293 cells was performed to support purification and characterization of Wise, Sost, LRP5, and LRP6 polypeptides.

Example 20

A method for the production of large quantities of Wise and Sost polypeptides is described. Bacteria cells transfected with either the Wise or Sost genes can be grown. *E. coli* strain DME558 is grown on LB agar plates at 37° C.

For P1 transduction, a P1 viral lysate of the *E. coli* strain DME558 is used to transduce a tetracycline resistance marker to strain BRE51 (Bremer, E., et al., FEMS Microbiol. Lett. 33:173-178 (1986)) in which the entire OmpA gene is deleted (Silhavy, T. J., et al., Experiments with Gene Fusions, Cold Spring Harbor Laboratory, Cold Spring Harbor, N.Y. (1984)). Strain DME558, containing the tetracycline resistance marker in close proximity of the OmpA gene, is grown in LB medium until it reached a density of approximately 0.6 OD at 600 nm. One tenth of a milliliter of 0.5 M $CaCl_2$ is added to the 10 ml culture and 0.1 ml of a solution containing $1 \times 10^9$ PFU of $P1_{vir}$.

The culture is incubated for 3 hours at 37° C. After this time, the bacterial cell density is visibly reduced. 0.5 ml of chloroform is added and the phage culture is stored at 4° C. Because typically 1-2% of the *E. coli* chromosome can be packaged in each phage, the number of phage generated covers the entire bacterial host chromosome, including the tetracycline resistance marker close to the OmpA gene.

Next, strain BRE51, which lacks the OmpA gene, can be grown in LB medium overnight at 37° C. The overnight culture is diluted 1:50 into fresh LB and grown for 2 hr. The cells are removed by centrifugation and resuspended in MC salts. 0.1 ml of the bacterial cells are mixed with 0.05 of the phage lysate described above and incubated for 20 min. at room temperature. Thereafter, an equal volume of 1 M sodium citrate is added and the bacterial cells are plated out onto LB plates containing 12.5 µg/ml of tetracycline. The plates are incubated overnight at 37° C. Tetracycline resistant (12 µg/ml) transductants are screened for lack of OmpA protein expression by SDS-PAGE and Western Blot analysis, as described below. The bacteria resistant to the antibiotic possess the tetracycline resistance gene integrated into the chromosome very near where the OmpA gene had been deleted from this strain. One particular strain was designated BRE-$T^R$.

A second round of phage production can be then carried out with the strain BRE-$T^R$, using the same method as described above. Representatives of this phage population contain both the tetracycline resistance gene and the OmpA deletion. These phage are then collected and stored. These phage are used to infect *E. coli* BL21(DE3). After infection, the bacteria contain the tetracycline resistance marker. In addition, there is a high probability that the OmpA deletion is selected on the LB plates containing tetracycline.

Colonies of bacteria obtained from plates are grown up separately in LB medium and tested for the presence of the Wise and Sost protein and OmpA protein as judged by antibody reactivity on SDS-PAGE western blots.

The SDS-PAGE is a variation of Laemmli's method (Laemmli, U. K., Nature 227:680-685 (1970)) as described previously (Blake and Gotschlich, J. Exp. Med. 159:452-462 (1984)). Electrophoretic transfer to Immobilon P (Millipore Corp. Bedford, Mass.) is performed according to the methods of Towbin et al. (Towbin, H., et al., Proc. Natl. Acad. Sci. USA 76:4350-4354 (1979)) with the exception that the paper is first wetted in methanol. The Western blots are probed with phosphatase conjugated reagents (Blake, M. S., et al., Analyt. Biochem. 136:175-179 (1984)).

Example 21

The fusion constructs of Example 18 can be used to transform the expression strain BL21 (DE3) ΔOmpA of Example 19. The transformation plates are cultured at 30° C. Colonies of both types are isolated from these plates and analyzed. It is generally found that virtually all transformants contained the desired plasmid DNA.

Various fusion-Wise clones are then analyzed for protein expression. The clones are induced and grown in LB media containing 0.4% glucose and 118 µM carbenicillin instead of ampicillin with an aeration speed of 100 to 150 rpm and at about 30° C. The expression of the Wise protein is analyzed by loading 0.1 ml of the culture of total *E. coli* proteins on an 8-16% gradient SDS gel.

*E. coli* strain BL21 (DE3) ΔOmpA [pNV-3] can be grown to mid-log phase (OD=0.6 at 600 nm) in Luria broth. Isopropyl thiogalactoside is then added (0.4 mM final) and the cells were grown an additional three hours at 30° C. The cells are then harvested and washed with several volumes of TEN buffer (50 mM Tris-HCl, 0.2 M NaCl, 10 mM EDTA, pH=8.0) and the cell paste stored frozen at −75° C.

For purification, about 3 grams of cells are thawed and suspended in 9 ml of TEN buffer. Lysozyme was added (Sigma, 0.25 mg/ml) deoxycholate (Sigma, 1.3 mg/ml) plus PMSF (Sigma, 10 μg/ml) and the mixture was gently shaken for one hour at room temperature. During this time, the cells lyse and release DNA causing the solution to become viscous. DNase is then added (Sigma, 2 μg/ml) and the solution again mixed for one hour at room temperature. The mixture is then centrifuged at 15 K rpm in an SA-600 rotor for 30 minutes and the supernatant discarded. The pellet is twice suspended in 10 ml of TEN buffer and the supernatants discarded. The pellet is suspended in 10 ml of 8 M urea (Pierce) in TEN buffer.

Alternatively, the pellet can be suspended in 10 ml of 6 M guanidine HCl (Sigma) in TEN buffer. The mixture is gently stirred to break up any clumps. The suspension is sonicated for 20 minutes or until an even suspension is achieved. 10 ml of a 10% aqueous solution of 3,14-ZWITTERGENT is added and the solution is thoroughly mixed. The solution is again sonicated for 10 minutes. Any residual insoluble material is removed by centrifugation.

This mixture is then applied to a 180.times.2.5 centimeter (cm) column of Sephacryl-300 (Pharmacia) equilibrated in 100 mM Tris-HCl, 1 M NaCl, 10 mM EDTA, 20 mM $CaCl_2$, 0.05% 3,14-ZWITTERGENT, pH=8.0. The flow rate is maintained at 1 ml/min. Fractions of 10 ml are collected. Three dimensional conformation was restored in Wise during the gel filtration. The absorbance (OD=280 nm) of each fraction is measured and those fractions containing protein are subjected to SDS gel electrophoresis assay for Wise. Those fractions containing Wise are pooled and stored at 4° C. for 3 weeks. During the incubation at 4° C., a slow conformational change occurs. The Wise protein remained in solution without the elevated levels of salt. The pooled fractions are then dialyzed against 50 mM Tris-HCl, 200 mM NaCl, 10 mM EDTA, 0.05% 3,14-ZWITTERGENT, pH=8.0. This material is applied to a 2.5×cm Fast Flow Q Pharmacia column equilibrated in the same buffer. Any unbound protein is eluted with starting buffer. A linear 0.2 to 2.0 M NaCl gradient is then applied to the column. The Wise elution profile can be characterized. Fractions are assayed by SDS-PAGE and the purest fractions pooled and dialyzed against TEN buffer containing 0.05% 3,14-ZWITTERGENT. Thus, cells transfected with the constructs can be isolated for Wise protein production. Similarly, Sost transfected cells can be isolated for Sost protein production.

Example 22

The family tree associations of relatedness between Sost, Wise, and other cysteine knot proteins were analyzed. Sost and Wise cysteine knot protein sequences were analyzed using BLAST, and all significant sequences were isolated. The cysteine knots from all sequences were aligned using the software T-Coffee and then analyzed with Phylip bootstrap neighbor joining methods. To determine chromosomal locations, Wise and Sost DNA sequences were compared against sequences in the mouse and Ensembl database (http://www.ensembl.org/Mus_musculus/blastview).

The BLAST program optionally filters out low-complexity regions from the search and assigns scores with well-defined statistical interpretation such that real matches of related sequences can be distinguished from random background hits. The default scoring matrix is BLOSUM62. The significance of each of the matches is given an Expect (E) score, defined as the expected number of alignments between a random query sequence and a database of random sequences of the same "effective" length and number that will score as well.

A Wise cDNA, (SEQ ID NO 1) was isolated and submitted to NCBI for BLAST sequencing. The Wise cDNA was comprised of 618 nucleic acids, corresponding to 206 amino acids in the wild type polypeptide molecule. 743,070 sequences were searched in the database. From this search, it was determined that Wise and Sost were related. Both genes had two exons and an intron. Exon 2 for both genes was 400 bp long and possessed two cysteine domains that were 70% identical.

Figure 9D:
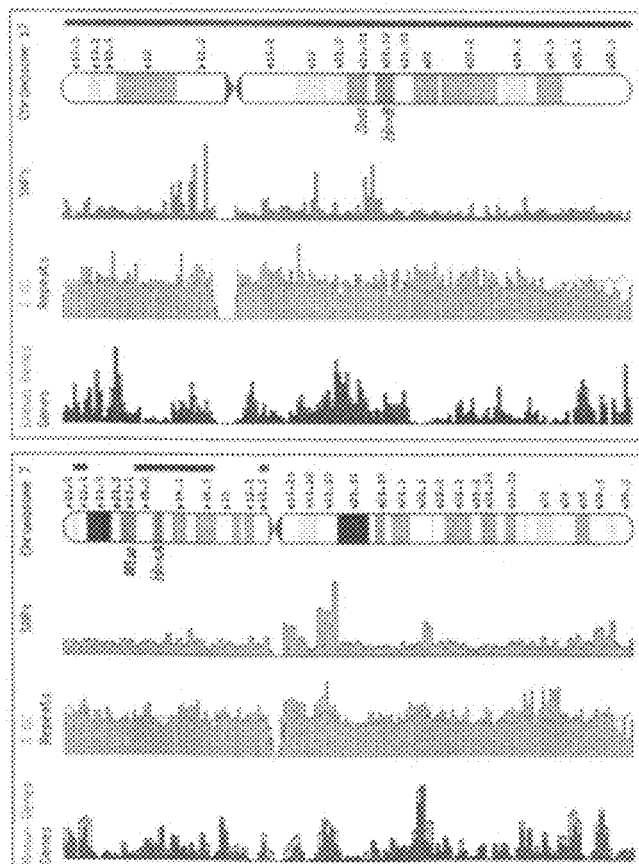
FIG. 9D illustrates the family tree map showing the relatedness of Wise and Sost to other cysteine knot family members.
Figure 9E:
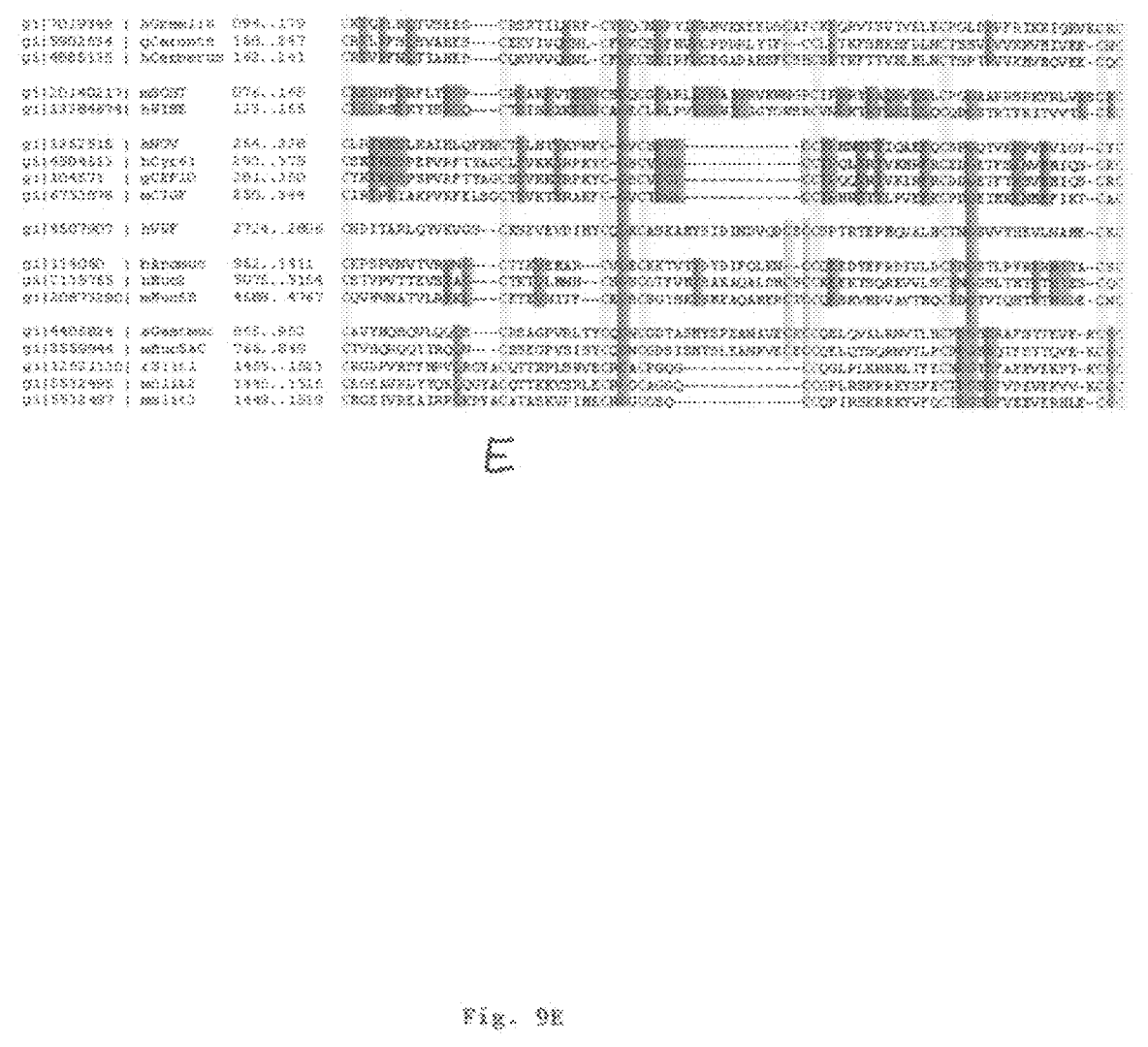

FIG. 9D shows the family tree relatedness between cysteine knot protein members Sost and Wise. In initial experiments, when the BLAST analysis was performed for Wise protein alone, only CCN family members (e.g., Slit, Mucin) were obtained as related family members. When Sost alone was run, only DAN family members (e.g., Caronte, Gremlin) were determined to be related. However, when Sost and Wise BLAST analyses were performed together, the family tree was that depicted in FIG. 9D. In this analysis of cysteine knot protein relatedness, it was noted that the DAN family had only one cysteine knot motif. In contrast, the CCN family and Slit and Mucin family possessed ten different protein motifs. Other family proteins had an additional cysteine knot moiety. G and P are conserved.

In FIG. 9D, the red dots indicate significant relatedness among cysteine knot proteins. Thus, FIG. 9D depicts the following family branch associations, wherein Sost and Wise are present in one branch. Nov, CTGF, Cyr61, and Cef10 are present in one closely related branch to Sost and Wise. Cerberus, Caronte, and Gremlin are in a second closely related branch. The aforementioned three branches are more remotely related to the following branches: the Muc2, Apomucpig, and Muc58 branch; the VWF branch, and the Slit 1, Slit2, Slit3, Muc5AC, and Gastmuc branch. Numerical values in the tree in FIG. 9D indicate a measure of the significance of protein associations. The closer a number is to 100, the more significant the association. Numerical values of less than 50 indicates insignificant associations. Thus, the numerical value of 97 between Sost and Wise is highly significant.

Example 23

An in situ protocol for detection of gene expression in Sost mutant mice was conducted. 3' untranslated regions of the Sost gene were obtained.

DNA from these 3' translated gene regions were linearized from the vector, then clipped at the 5' end. Subsequently, this sequence was transcribed to produce an antisense RNA molecule. The antisense RNA molecule was labeled with a deoxygenin (DIG) substrate tag. The DIG-labeled RNA was then utilized to bind to an embryo's RNA.

In preparation for staining, a whole embryo was dehydrated and then bleached at the pigment stage. The next day, the embryo was washed and treated with detergent to induce permeability in subsequent staining. When the DIG-labeled RNA was incubated with RNA from an embryo, a purple-blue color was developed in whole embryo staining in the presence of alkaline phosphatase, NBT and BCIP. Using this procedure, Sost expression in whole embryo tissue was characterized.

Example 24

A chick Wise pET28b vector was made. The Novagen pET28b(+) vectors used contained f1 origin, N-terminal histidine, T7, and optional C-terminal histidine tags. Single-stranded sequencing was performed using the T7 terminator primer. An EcoR I-HinD III nucleic acid fragment was obtained from a chick Wise-containing pcDNA3.1-Myc-His vector for insertion into the pET28b vector by established Novagen methods (Novagen, Madison, Wis.) described in various pET28b examples herein.

Example 25

A mouse Sost pET28b vector was made. A Sost-V5 epitope-tagged version was utilized as a base construct for making the pET28b(+) construct. Subsequently, Sost was removed from the base construct using BamHI and XhoI enzymes and inserted into pET28b vectors according to Novagen methods as previously described. The Sost-containing preparation was expanded using the PCR method. Nucleic acids encoding thirteen excess amino acids were removed 5' from the start codon of the Sost nucleic acid sequence utilizing the Stratagene site-directed mutagenesis kit. Also removed were extra restriction enzyme sites adjacent to Xho or located at the 3' end of Sost. Naturally occurring nucleic acids in Sost encoding the last six ELENAY amino acids were added using mutagenesis.

Example 26

In this Example, the chick Wise-FLAG sequence was inserted into the pCS2+ vector by procedures discussed in Example 19. The chick Wise sequence was placed in the pCS2+ vector using the EcoRI and SpeI/XbaI nucleases by cloning. The pCS2+ vector also contained T7, ClaI, BamHI, Sp6, and CMV sites. The chick Wise polypeptide was expressed and used to determine binding to LRP and BMPs.

Example 27

This Example briefly describes the insertion of a mouse Sost sequence into the pcDNA3.1/V5-His-TOPO® vector. This TOPO® vector includes a CMV promoter, T7 promoter/priming site, multiple cloning site, V5 epitope, polyhistidine tag, SV40 promoter, neomycin resistance gene, and ampicillin resistance gene. Mutagenesis permitted creation of the wild type Sost-V5 vector using the following steps: (1) addition of the sequence encoding six ELENAY amino acids, and (2) addition of the EcoR I site to the 5' end of the Sost sequence.

Example 28

Human wild type LRP6 and mutant LRP6-Δ3,4 gene constructs in the pET28b vector were created and characterized. These gene constructs can then be utilized for the production of the corresponding mutant LRP6-Δ3,4 protein molecule. After cloning the foregoing LRP6 gene construct into the pET28b vector by the method previously described in Example 3, the pET28b vector DNA was digested with BamHI and XhoI enzymes to yield the LRP6 sequence in soluble form for further characterization. This nucleic acid sequence was not linked to the transmembrane.

The EcoRV site was then mutated within the vector backbone using the Stratagene II QuikChange XL-Site Directed mutagenesis kit. This kit's procedure is used to make point mutations, amino acid substitutions, frame shift mutations, or insertion of single or multiple adjacent amino acids in Wise and Sost genes that encode polypeptides. The pET28 vector was digested with XhoI and EcoRV. The purified BamHI/EcoRV restriction enzyme fragment was cloned into pET28b. The first band corresponded to EGF1,2; and the second band corresponded to EGF3,4. The LRP6-derived EGF1,2 fragment was cloned into the pET28b vector containing BamHI and EcoRI sites by homologous recombination as previously described in Example 13. The Stratagene mutagenesis kit was used to obtain mutations in the pET28b vector containing the LRP6-derived EGF1,2 sequence. Subsequently, XhoI, NotI and EcoRV sites were introduced into the multiple cloning site of the pET28b vector. These sites permitted opening of the circular nucleic acid sequence with EcoRV and BamH endonucleases to allow insertion of the LRP6-derived EGF1,2 fragment into the pET28b vector. LRP6-Δ3,4 protein was then expressed from the pET28b vector.

Example 29

This Example relates to the creation of the human LRP5Δ3,4 mutant-containing pET28b vector. Similarly, an LRP5 Δ-4 mutant-containing pET-28b vector can be made. A human LRP5 nucleic acid sequence inserted into the CS2+ vector was obtained. The coding sequence for LRP5 in this vector runs from the EcoRI site to the XbaI site. The intact LRP5 was obtained by digestion with EcoR I and Xba I nucleases. As in Example 18, the purified BamHI/XbaI fragment was then digested with the XhoI enzyme to yield two bands, corresponding to LRP5 EGF1,2 and EGF3,4 fragments. As previously, the LRP5 EGF1,2 sequence was inserted into the p28b vector containing EcoRI and XhoI sites. Site-directed mutagenesis was used to (1) remove the stop codon 5' to the actual start site and (2) delete extraneous nucleic acids located 5' to the start of the LRP sequence. The LRP Δ3-4 and LRP Δ3-4 vector subsequently can be used to independently transfect E. coli cells for production of LRP Δ3-4 and LRP Δ3-4 polypeptide molecules respectively.

Example 30

This Example relates to the creation of the secreted LRP5-myc CS2+ vector. The human LRP5 containing pCS2 vector was obtained. Stratagen site-directed mutagenesis resulted in the following sequence modifications: (1) addition of the Myc tag upstream of the transmembrane domain, and (2) addition of XbaI and XhoI sites flanking the Myc tag region. Removal of the LRP5 sequence encoding the region that tethers the protein to the membrane was performed by digestion with XbaI nuclease. The resultant religated nucleic acid sequence encoded a secreted form of LRP5, lacking the tethered portion.

Example 31

Hybridoma cell lines were prepared that can secrete monoclonal antibodies reactive with Wise wild type proteins, polypeptides, whole molecules, and fragments. The technology for producing monoclonal antibodies is well known. See generally E. A. Lerner, "How To Make A Hybridoma", Yale J. Biol. Med., 54, pp. 387-402 (1981); M. L. Gefter et al., "A Simple Method For Polythylene Glycol-Promoted Hybridization Of Mouse Myeloma Cells", Somatic Cell Genet., 3, pp. 231-36 (1977). Briefly, murine X63AG8.653 myeloma cells are fused to lymphocytes isolated from spleens of mice immunized with a preparation comprising of Wise polypeptide (e.g., wild type Wise polypeptide SEQ ID NOS 45, 114-119), and the culture supernatants of the resulting hybridoma cells are screened as described herein for anti-Wise antibody binding activity. The myeloma cell line is HAT-sensitive, wherein growth in HAT medium selects for growth of HAT-resistant hybridoma cells.

To prepare Wise protein Immunogen, KLH-Immunogen is made. Wise Immunogen may be derived from Wise proteins or polypeptides. Representative Wise wild type proteins and polypeptides are SEQ ID NOs 45, 52, 104-106, and representative Wise mutant polypeptides are SEQ ID NOs 114-119. Each Balb/c mouse is immunized subcutaneously with 0.2 ml of a preparation containing about 100 µg of Wise polypeptide in PBS ("Immunogen") mixed 1:1 with Complete Freund's Adjuvant (CFA). Wise polypeptide was produced according to the method described in Examples 20-21. The Wise Immunogen polypeptide can be derived from wild type Wise molecules, as specifically described in SEQ ID NOs 45, 52, 104-106, 114-119. Shortened Wise polypeptide molecules are SEQ ID NOs 115-119. Three days after the final booster injection, mice are exsanguinated, antisera titrated, and isolated spleen cells are fused with the non-secreting mouse myeloma cell line, SP2/0 Ag 14 (ATCC Designation CRL 8287). Thielmans, K., et al., J. Immunol. 133:495 (1984).

Prior to fusing, the resultant mouse antisera are titered to determine the concentration of anti-Wise antibodies made by each mouse. Pre-immune sera noted above are diluted in the same manner as the immune sera and used as controls. Microtiter wells are coated with 1.5 µg of BSA-Wise antigen prepared by incubating bovine serum albumin (BSA from Calbiochem, Catalog #12657, as described by Makita et al., J. Biol. Chem., 267(8), pp. 5133-5138 (1992). The antigen coated wells are sealed with Mylar sealing tape (Corning) and incubated overnight at 4° C. The microtiter plates are subsequently washed and blocked in a BSA-containing solution. After incubation, the microtiter plates are washed and 100 µl of a goat anti-mouse IgG (gamma chain specific) horseradish peroxidase-conjugated antibody (Sigma) is added to all wells and incubated. Ortho-phenylenediamine (OPD) Peroxidase Substrate (Sigma) is added to all wells and incubated. After the incubation period, the plates are read at 450 nm on a microtiter plate reader.

Anti-Wise antibodies are further characterized by their reactivity with the mouse bone, tooth, kidney, and other tissue, including but not limited to osteoblasts and osteoclasts. Monoclonal or polyclonal anti-Wise antibodies can be tested in an immunohistological assay using tissues, biochemically in an immunoprecipitation assay, and functionally in a Wnt pathway activation or inhibition assay. Briefly, anti-Wise antibodies are tested for reactivity with a panel of mouse sectioned or whole mount tissues and by immunofluorescence staining with fluorescein or rhodamine conjugated goat anti-mouse or rabbit immunoglobulin heavy or light chain reagents (TAGO, Burlingame, Calif.) using standard techniques. See Thielmans, K., et al., J. Immunol. 133:495 (1984) and Samoszuk, M. K., et al, Hybridoma 6:605 (1987). Other colorimetric immunological reagents may be utilized in this immunohistological method. Alternatively, tissue-derived cell suspensions can be analyzed by either fluorescence microscopy or flow cytometry using a fluorescence activated cell sorter (Becton Dickinson FAXS 440, Mountain View, Calif.).

In a biochemical functional assay, anti-Wise antibody may be used to bind Wise protein or polypeptide, thereby inhibiting binding of Wise to LRP. Wise-FLAG and LRP-MYC reagents are made such that addition of anti-Wise antibody prevents Wise binding to LRP. In addition, anti-Wise antibody may immunoprecipitate Wise-FLAG, forming an antibody-antigen complex that is then detectable on Western blot analysis. Therefore, this assay may be used to detect anti-LRP antibody activity in functional inhibition of Wise-LRP binding. This functional assay is used as a screening tool to obtain antibodies, both monoclonal and polyclonal, which functionally bind to Wise protein in vitro and in vivo and prevent Wise binding to LRP. Similarly, anti-LRP antibodies may be screened. It is predicted that such therapeutic anti-Wise antibodies and anti-LRP antibodies can be used in vitro and in vivo to increase osteoblast number and bone mineral density and bone deposition.

In a luciferase assay, anti-Wise antibody may function to activate the Wnt pathway. Here, Human293 cells are used wherein anti-Wise antibody binds to Wise and prevents such Wnt pathway inhibition.

Upon completion of testing of anti-Wise antibodies in at least one of the above assays, those mouse sera and rhybridoma clones producing monoclonal antibodies that are reactive against Wise present in bone cells (osteoblasts, osteoclasts) can be selected for further expansion and processing. Goat antisera containing polyclonal antibodies reactive against Wise can also be produced.

Hybridoma production can be carried out by fusing the mouse spleen cells with the myeloma X63AG8.653 cell line by the procedure described in Harlow, E. and D. Lane, Antibodies: A Laboratory Manual, Cold Spring Harbor Laboratory, 1988. The Sp-2/0 myeloma cell line may also be used. Briefly, spleen cells are mixed with HAT-sensitive X63AG8.653 myeloma cells and fused with polyethylene glycol (PEG) (e.g., 50% PEG 4000, Sigma Chemicals). Subsequent to fusion of spleen cells with the myeloma cell line, 1 drop of the 50 ml fusion mixture is added to each of 96 wells in 10 microwell cell culture plates (Corning). After culture of clones in selection media, hybridoma cultures are screened for antibody production to Wise antigen as follows:

Wise-polypeptide coated wells are prepared. Further, BSA is coated on wells following the same coating procedure as with BSA-Wise to detect any nonspecific binding. The antigen coated plates are used to screen cell culture supernates from each of the parental cultures. The parental supernates are added to one well of BSA-Wise-coated microtiter plate and to one well of BSA coated plate. The plates are incubated and washed. Goat anti-mouse IgG (gamma chanin specific) horseradish peroxidase-conjugated antibody is added to each well. Parental cultures are identified that produce absorbance readings exceeding 0.3 O.D. on the BSA-Wise wells and no reactivity on the BSA coated wells. The latter parental cultures are expanded in culture in 24 well macrowell plates (Corning) and upon further supernatant/antibody evaluation, three parental cultures are re-cloned (secondary cloning). Following a procedure described in Harlow and Lane, supra, the parental cultures are diluted in RPMI 1640 culture medium containing 20% fetal bovine serum to give a cell density of 0.5-10 cells per well on wells that are precultured with splenocyte feeder cells.

After two weeks parental cell culture supernates are tested to determine the wells that are positive for monoclonal anti-Wise antibody activity using the screening procedure above. Positive wells are cloned and subcloned. Clonal cultures can be identified with high viability and producing the highest titer antibody to BSA-Wise in the aforementioned antibody screening assay. Secondary and tertiary subcloning of the latter is done to assure monoclonality and stability of the resultant clones. Comparative affinity analysis may be performed in accordance with Macdonald et al. (Macdonald, R. A. et al. 1988. Journal of Immunological Methods, 106:191-194). The cells from each culture are prepared in accordance with Harlow and Lane, supra, for frozen storage in ampoules in liquid nitrogen. Each single clone is expanded in culture and adapted to a protein-free medium (MaxiCell/Hybridoma-PF Medium, Cat. No. N10105, Atlanta Biologicals, Norcross, Ga.) for monoclonal antibody production. Thus, anti-Wise monoclonal antibodies are prepared that can be utilized in subsequently described bone deposition experiments.

Next, monoclonal antibodies from subclones can be tested against Wise wild type and mutant polypeptides for binding by direct ELISA and competition ELISA methods. For direct ELISA, BSA-Wise is coated on microtiter plates, the unbound sites are blocked by incubation with Assay Buffer (25 mM borate, pH 8.0, 150 mM NaCl, 0.01% EDTA and 1% BSA). The plate is washed 6× and increasing concentrations of monoclonal antibody (mAb) in Assay Buffer are added. After this incubation, the plate is again washed and incubated with alkaline-phosphates labeled goat anti-mouse antibodies (Cappel, Durham, N.C.) diluted 1:1000 in Assay Buffer. The unbound antibodies are removed by extensive washing and the bound antibodies are detected by addition of p-nitrophenylphosphate (PNPP). The optical density at 410 nm is recorded.

The competition ELISA can be performed by pre-coating microtiter plates with BSA-Wise wild type and mutant polypeptides and blocking with Assay Buffer. The plate is washed, and monoclonal anti-Wise antibody is added with increasing, concentrations of the Wise wild type and mutant polypeptide antigen competitors, simultaneously incubating the mixture for 1 hr at 37° C. The unbound materials are removed by extensive washing and the bound mAb is detected with alkaline phosphatase labeled anti-mouse antibodies similar to the direct ELISA method above. All washes are in TBS-T wash solution; all incubations proceeded for 1 hr at 37° C. It is predicted that monoclonal antibodies directed against Wise immunogen will bind specifically to Wise wild type molecules. Such anti-Wise monoclonal antibodies, depending on their reactivity profiles, may or may not bind to Wise mutant molecules that do not bind to LRP.

Fab fragments of anti-Wise antibodies can be prepared. After purification of anti-Wise IgG antibody, Fab fragments are prepared by papain cleavage. Mercuripapain is pre-activated with 10 mM cysteine in 1.25 mM EDTA for 15 min at 37° C., then added to the IgG antibody (5-10 mg/ml) at a 1:50 to 1:200 (w/w) ration of enzyme to antibody. The period of incubation at 37° C. ranged between 15 min to 5 hours to determine the optimum time of incubation for maximal Fab yield. Addition of iodacetamide (20-50 mM) stopped the cleavage process. Conditions are optimized by SDS-PAGE. analysis of resultant reaction products.

Thus, anti-Wise monoclonal antibodies and Fab "miniantibody" fragments are prepared that can be utilized in subsequently described experiments below wherein such antibodies are delivered in liposomes to bone cells (e.g., osteoblasts) for the purpose of increasing bone deposition and bone mineral density in vitro and in vivo. Anti-Wise Fab fragments are predicted to have greater anti-Wise inhibitory activity than whole anti-Wise antibody. Both anti-Wise antibodies and their corresponding Fab fragments are expected to bind to Wise molecules in osteoblasts and prevent Wise molecule binding to LRP molecules (e.g., LRP5, 6).

Example 32

Hybridoma cell lines can be prepared that can secrete monoclonal antibodies reactive with Sost wild type proteins, polypeptides, whole molecules, and fragments according to the procedure described in Example 31 above. Briefly, murine myeloma cells are fused with murine splenic lymphocytes from mice immunized with Sost-derived antigen. Hybridomas making monoclonal antibodies reactive against Sost antigen are selected, grown, and monoclonal antibodies can then be screened with Sost antigen in EIA assays, histological tissue staining assays, immunoprecipitation assays, and functional assays as previously described. Fab fragments of anti-Sost antibodies can be prepared by standard papain and pepsin enzymatic digestion methods.

Example 33

This Example relates to detection and analysis of the wild type, and also genetically modified, Wise cysteine knot regions in mammalian cells. Similarly, detection and analysis of the Sost cysteine knot region from wild type or genetically modified cells may be executed. In this procedure, murine C57BL/6 osteoblasts, producing Wise polypeptide are isolated. Other isolated or cultured mammalian cells can be used. Genetically modified Wise molecules can be made as presented in Example 18-21, wherein the stop codon in the Wise Neo-lacZ cassette, which is subsequently inserted into ES cells, encodes a truncated Exon 2 polypeptide product that comprises part of the cysteine knot region of Wise. After PCR amplification of these shortened Wise nucleic acid sequences by standard molecular biology cloning techniques, such sequences are placed on Southern blots for gDNA and on Northern blots for mRNA species. J. Sambrook and D. W. Russell, Molecular Cloning: A Laboratory Manual, $3^{rd}$ edition (2001).

More specifically, Wise gene nucleic acid fragment sequences for SEQ ID NOs 1-5 and 126-128 may be made and amplified by standard PCR technologies. These Wise nucleic acid sequences encode corresponding polypeptides. A smaller Wise gene DNA or RNA probe sequence corresponding to SEQ ID NO 1 can be synthesized (see SEQ ID Nos 136-140). Alternatively, site specific mutagenesis or in vitro transcription methods may be utilized. The DNA probe can then be labeled with P-32 cytosine (CTP). Alternatively, C-14, H-3, or other radiolabels or nonradioactive labels (e.g., DIG) may be used. In addition, the RNA probe can be labeled with P-32 uracil. Once Wise DNA probes are labeled with P-32 cytosine, these radiolabeled probes may be hybridized to nucleic acids extracted from Wise-containing cells to characterize such Wise genes after Southern blot analysis. Similarly, radiolabeled Wise RNA probes may be hybridized to nucleic acids from Wise-containing cell extracts. It was observed that these Wise RNA fragments detected the presence of Wise nucleic acid sequences in the cell extracts.

Example 34

Wise antigens to be prepared for immunization and to be used as standards in immunoassays include, but are not limited to, Wise wild type polypeptide whole molecule and polypeptide fragments. In addition, the corresponding Wise-derived nucleic acid molecules to the aforementioned polypeptide molecules were produced as antigens for immunizations and standards. Both Wise-derived polypeptide and nucleic acid antigens are prepared as previously described herein.

Goat and rabbit polyclonal antibodies and mouse monoclonal antibodies to the Wise-derived wild type and mutant polypeptide and nucleic acid molecules are prepared by methods that are known to those of skill in the art. E. Harlow and D. Lane, Antibodies: A Laboratory Manual, Cold Spring Harbor Laboratory, New York, 1988. Similarly, goat and rabbit polyclonal antibodies and mouse monoclonal antibodies may be made to Sost-derived wild type and mutant polypeptides and nucleic acid molecules. The procedure for production of monoclonal antibodies to specific antigens has been described in detail herein. Once monoclonal and polyclonal antibodies to Wise-derived polypeptide and nucleic acid molecules have been made, they can be utilized in immunodiagnostics kit assays for the detection and quantitation of the Wise-derived molecules.

Example 35

A Sost-specific monoclonal antibody can be made by the procedure as delineated in Examples 32 and 33. Sost-specific monoclonal antibodies may be made against Sost wild type and mutant proteins and polypeptides. These antibodies would inhibit the binding of Sost to LRPs.

Example 36

This Example relates to the production of monoclonal antibody to the terminus region of LRP5 which binds to Wise protein. This LRP5 terminus region also binds to Sost protein. The anti-LRP5 antibody is predicted to inhibit binding of Wise to LRP5 and thereby result in phenotypic changes such as increased osteoblast number, increased bone mineral density and bone deposition, and tooth and ocular phenotypic changes. Similarly, the anti-LRP5 antibody is predicted to inhibit binding of Sost to LRP5, resulting in similar phenotypic changes.

LRP 5 Δ3-4 mutants are made as described in Examples 28 and 29. Such LRP5 Δ3-4 mutant nucleic acid sequences can be inserted into either p28b vectors as described in Examples 28 and 29, or Neo-lacZ cassettes (without stop codons) as described in Example 13. *E. coli* cells containing the p28b vector with the LRP5 mutation, and ES cells containing the Neo-lacZ cassette with the same mutation are cultured, lysed, and LRP5 Δ3-4 purified.

Monoclonal antibody can be made to LRP5 by immunization of mice with LRP5 as described in Example 32, hybridization of LRP5 immunized mouse splenic lymphocytes with HAT-sensitive myeloma cells, and selection of HAT-resistant hybridoma cells secreting antibodies that bind LRP5. Once clones are identified that secrete antibody binding to LRP5, clones are further screened for failure to bind LRP5 Δ3-4 in EIA and functional assays as described in Example 32. Such hybridoma clones that bind to wild type LRP5 molecules yet do not bind to LRP5 Δ3-4 molecules are deemed to be putative anti-LRP5 Δ3-4 region-epitope specific antibodies (LRP5 Δ3-4). Photoreactive chemical conjugation of H3-radiolabeled antibody combining sites to the LRP5 molecule can verify this antibody-specific attachment to the terminal amino acid sequence of LRP5.

Example 37

This Example relates to the production of monoclonal antibody to the terminus region of LRP6 which binds to Wise protein. The anti-LRP6 antibody is predicted to inhibit binding of Wise to LRP6 and thereby result in phenotypic changes such as increased osteoblast number, increased bone mineral density and bone deposition, and tooth and ocular phenotypic changes. Similarly, the anti-LRP6 antibody is predicted to inhibit binding of Sost to LRP6, resulting in similar phenotypic changes.

LRP 6 Δ3-4 mutants are made as described in Examples 28-29. Such LRP 6 Δ3-4 mutant nucleic acid sequences can be inserted into either p28b vectors as described in Examples 28-29, or Neo-lacZ cassettes (without stop codons) as described in Examples 13. *E. coli* cells containing the p28b vector with the LRP6 mutation, and ES cells containing the Neo-lacZ cassette with the same mutation are cultured, lysed, and LRP6 Δ3-4 purified.

Monoclonal antibody can be made to LRP6 by immunization of mice with LRP6 as described in Example 32, hybridization of LRP6 immunized mouse splenic lymphocytes with HAT-sensitive myeloma cells, and selection of HAT-resistant hybridoma cells secreting antibodies that bind LRP6. Once clones are identified that secrete antibody binding to LRP6, clones are further screened for failure to bind LRP 6 Δ3-4 in EIA and functional assays as described in Example 32. Such hybridoma clones that bind to wild type LRP6 molecules yet do not bind to LRP 6 Δ3-4 molecules are deemed to be putative anti-LRP6 Δ3-4 region-epitope specific antibodies (LRP6 Δ3-4). Photoreactive chemical conjugation of H3-radiolabeled antibody combining sites to the LRP6 molecule can verify this antibody-specific attachment to the terminal amino acid sequence of LRP6.

Example 38

This Example relates to the production of biotinylated liposomes which are then linked to monoclonal antibodies specific for osteoblasts through an avidin linkage. These anti-osteoblast antibody-armed liposomes can be utilized to deliver encapsulated anti-Wise antibody to osteoblasts. Similarly, encapsulated anti-Sost antibody may be made and delivered to osteoblasts. Liposomes may be armed with anti-osteoblast (anti-OB) antibodies that react with either mouse or human osteoblasts as described herein. Delivery of anti-Wise antibodies to osteoblasts using encapsulated liposomes is anticipated to result in increased osteoblast growth and proliferation with concommitant increased bone deposition.

Biotinylated phospholipids are initially prepared. Biotinylated phospholipids are prepared by dissolving phosphatidylethanolamine (PE, 5.1 mg) or phosphatidylserine (PS, 3.9 mg) in a solution (170 μl for PE; 130 μl for PS) of chloroform-methanol (2:1) with biotinyl N-hydroxysuccinimide ester (BNHS, 3.3. mg) (Sigma Chemicals, St. Louis, Mo.). 10 μl is added of a chloroform solution containing 15% (v/v) triethylamine. After a two hour incubation of the reaction mixture at ambient room temperature (18° C.), the crude mixture is stored at −70° C.

The crude biotinylatedlipid is then purified by high-performance liquid chromatography (HPLC) using a Waters system (Waters Associates, Milford, Mass.) with two solvent delivery units (M-45 and Model 510) and a Model 680 gradient controller. Separations are performed using a stainless steel column (250×4.6 mm i.d.) packed with 5 μm Lichrosorb Si-100 silica (Merck, Darmstadt, Germany) at room temperature with a flow rate of 1 ml/min. After a first wash with solvent A (n-hexane/2-propanol/sater in a ratio of 60:80:14, v/v/v), Solvent B (n-hexane/2-propanol/water 60:80:7, v/v/v) is added until a new baseline is stabilized.

10 μl of the crude biotinylated lipid starting reaction mixture containing 390 nmol lipid is applied to the HPLC column using a Hamilton syringe, and the elution is monitored utilizing an M-441 UV detector (214 nm). The column is eluted for 5 min with solvent A, then with a 20 min linear gradient between 0 and 100% solvent B in A. Solvent B is then passed over the column until a stable baseline is obtained.

The average retention times of BPE and BPS are 20.7 min (17-22) and 27.1 min (26-28), respectively. The HPLC peaks are collected in a Gilson Microfractionator, and the eluted material is pooled. The solvent is then evaporated under a stream of nitrogen, and the biotinylated lipid is stored at −70° C.

Both the initial crude reaction mixture and the HPLC-purified BPE and BPS fractions are analyzed by thin-layer chromatography (TLC) in silica gel-coated plates (Riedel-de Haen, Germany). For BPE plates, a chloroform/methanol/water (80:25:2) solution is used; and for BPS plates, a chloroform/methanol/acetic acid (30:4:3) solution is used. Phospholipid visualization occurs through one of three methods: (1) exposure to iodine vapors, (2) a biotin-specific spray (dimethylaminocinnamaldehyde) See D. B. McCormick and J. A. Roth Methods in Enzymology 148A: 383 (1987), or (3) a phosphate-specific spray. See V. E. Vaskovsky and E. Y. Kostetsky, J. Lipid Res. 9: 396 (1968). All three staining methods reveal that BPE has an $R_f$=0.65, and BPS has an $R_f$=0.55.

Biotinylated liposomes are then prepared. Biotinylated phospholipids (BPE or BPS) are dissolved in chloroform/methanol (2:1) and molar equivalents of each corresponding lipid (BPE or BPS) are added to 12 mm×75 mm glass tubes to yield the final percentage of biotinylated lipid desired (e.g., 5, 10, 20%). Concentrations of 0.01 to 1 mol % of total lipid are achieved.

To prepare liposomes, the biotinylated lipid/native lipid mixture (e.g., 2 μmol of the stock lipid mixture in chloroform/methanol) is evaporated to dryness under a stream of nitrogen and then placed in a vacuum dessicator overnight. The lipid is resuspended by syringe injection (e.g., 50 μl lipid in chloroform/methanol into 1.0 ml PBS) in a final concentration of 1 mg/ml in PBS, pH 7.2-7.4, then sonicated under nitrogen in an ice-cooled chamber for 10 min in a Branson Sonifier Model 130. The resulting suspension is centrifuged at 10,000 rpm for 20 min, and the biotinylated liposomes in the supernatant fraction used within 24 hours after preparation.

To encapsulate anti-Wise antibodies, the biotinylated lipid/native mixture is resuspended by injection (e.g., 50 μl lipid in chloroform/methanol into 1.0 ml PBS) into an anti-Wise antibody-containing PBS solution. After sonication and centrifugation at 10,000 rpm for 20 minutes, anti-Wise antibody-biotinylated liposomes are purified by one of the following procedures: (1) in one preferred procedure, liposome preparations are centrifuged at 13,000×g in a microcentrifuge; pelleted liposomes are washed with PBS, and pelleted liposome fractions are resuspended in PBS buffer for use; (2) in another method, liposome preparations are passed over a Sephadex 200 column (Pharmacia, Piscataway, N.J.) in PBS. The liposomes are eluted in the PBS void volume, with free protein and contaminants appearing in subsequent collection.

Once the liposomes are prepared, Fab fragments of anti-osteoblast cell (anti-OB) antibodies must be prepared. Rat anti-mouse Thy-1 monoclonal antibody and mouse anti-human Thy-1 monoclonal antibody are obtained from Pharmingen (San Diego, Calif.). Thy 1 is known to be an expressed surface antigen on osteoblast cells. X-D Chen, et al., Thy-1 Antigen Expression by Cells in the Osteoblast Lineage, J. Bone & Mineral Research 14(3): 362-375 (1999). Other suitable osteoblast-reactive antibodies have been described. See, e.g., Aubin, J. E. et al. Monoclonal antibodies as Tools for Studying the Osteoblast Lineage, Microsc Res Tech 33:128-140; Bruder S P et al. (1996) Monoclonal Antibodies Selective for Human Osteogenic Cell Surface Antigens, Bone 21:225-235. After purification of anti-OB IgG antibody, Fab fragments are prepared by papain cleavage. Mercuripapain is pre-activated with 10 mM cysteine in 1.25 mM EDTA for 15 minutes at 37° C., then added to the IgG antibody (5-10 mg/ml) at a 1:50 to 1:200 w/w ratio of enzyme to antibody. The period of incubation at 37° C. ranged between 15 minutes to 5 hours to determine the optimum time of incubation for maximal Fab yield. Addition of iodoacetamide (20-50 mM) stopped the cleavage process. Conditions are optimized by SDS-PAGE analysis of resultant reaction products.

Biotinylated Fab fragments of anti-OB antibodies are obtained by using an N-hydroxysuccinimidobiotin (NHS-Biotin, Sigma Chemical, St. Louis, Mo.). In this method, 2 mg of Fab fragments are dissolved in 1 ml of sodium phosphate buffer (PBS), pH 7.5-8.5, in a 16×125 mm test tube. Immediately before use, 1 mg of NHS-Biotin is dissolved in 1 ml dimethylformamide (DMF). 75 μl of the dissolved NHS-Biotin is added to the Fab containing test tube. The tube is incubated on ice (4° C.) for 2 hours. The unreacted biotin may be removed by dialysis (e.g., Slide-A-Lyzer Dialysis Cassette) or with a D-Salting Column (Pierce Chemical, Rockford, Ill.). Alternative, unreacted biotin may be removed by centrifugation of the product at 1000×g for 15-30 minutes using a microconcentrator. After centrifugation, the sample is diluted in 0.1 M sodium phosphate, pH 7.0. The process can then be repeated twice more. The biotinylated protein may be stored at 4° C. in 0.05% sodium azide prior to use.

Finally, Fab-anti-Wise liposomes utilizing biotinylated Fab molecules, biotinylated liposomes and avidin are prepared. The biotinylated Fab fragments in PBS are mixed with a twenty-fold molar excess of egg white avidin (Vector labs, Burlingame, Calif.; Sigma Chemical, St. Louis, Mo.), incubated overnight at 4° C. The excess avidin is removed by passage of the mixture over anti-human light chain affinity columns (e.g., Pharmacia Sepharose 4B). Fab-biotin-avidin molecules are eluted with citrate buffer, pH-4.0, then pooled fractions are dialyzed against PBS, pH=7.0. A suspension of biotinylated anti-Wise antibody-containing liposomes is mixed with Fab-biotin-avidin solutions in PBS to yield avidin to free biotin ratios on the liposome surfaces of approximately 2:1, 5:1, 10:1, and 20:1 molar ratios. After incubation overnight at 4° C. on a rotational shaker, liposomes are passed through a Pharmacia Sephadex G-200 column. The Fab-anti-Wise liposomes are collected in the void volume and resuspended in PBS.

Alternatively, biotinylated anti-Wise antibody-containing liposomes are mixed with a twenty-fold molar excess of strepafidin, incubated overnight at 4° C., then biotinylated-avidin liposomes are passed over the anti-human light chain affinity column. Biotinylated-avidin anti-Wise liposomes are eluted with a citrate buffer, pH=4.0, then pooled fractions are dialyzed against PBS, pH=7.0. After dialysis, biotinylated-avidin liposomes are mixed with biotinylated Fab fragments in PBS in the above approximate molar ratios. Similarly, after incubation overnight at 4° C. on a rotational shaker, liposomes are passed through a Pharmacia Sephadex G-200 column. The Fab-Anti-Wise antibody liposomes are collected in the void volume and resuspended in PBS.

Example 39

The present Example relates to in vitro treatment of mouse bone cells (e.g., osteoblasts and osteoclasts) by anti-Wise-specific Fab liposomes armed with anti-osteoblast antibody as prepared in Example 40. The anti-Wise antibody may have specificity for Wise whole molecule or polypeptides. Similarly, anti-Sost antibody may be encapsulated in liposomes to obtain osteoblast phenotypic effects in vitro. First, murine bone cells are purified by fluorescence/activated cell sorting (FACS) using anti-bone marker antibodies. In addition, mouse bone cell osteoblasts can be prepared essentially as described by Takahashi et al., 1988 Endocrinology 123:2600-

2602; and by Tanaka et al., 1992 J. Bone Min Res. 7:S307, which are incorporated by reference herein. These bone cells are liquid nitrogen-cryopreserved in ampoules.

Bone cells are separated by fluorescence activated cell sorting (FACS) utilizing the FACStar-PLUS flow cytometer (Becton Dickinson) equipped with two 5-watt argon ion lasers and a tunable dye laser interfaced with a Digital Equipment Corporation Vas Station-4000/90 computer and data collection/analysis software. Bone cells are prepared by suspension in MACS (magnetic sorting) buffer with fluorescein-conjugated antibody directed against mouse osteoblasts (DAKO, Carpenteria, Calif.) in a tube and vortexed. After incubation for 30 minutes at 4° C., cells are washed 3-5 times in MACS buffer, then centrifuged at 400×g for 5 minutes at 4° C. Cells are placed in MACS buffer at 4° C. for separation in the FACStar flow cytometer. Mouse bone cells are separated on the basis of the fluorescence and size. Aliquots of purified murine osteoblasts and osteoclasts cells are tested for reactivity with anti-Wise antibodies in a fluorescence sandwich immunoassay with murine monoclonal anti-Wise antibody made according to the method of Example 32 and fluorescein-conjugated goat anti-mouse IgG antibody (H & L) (DAKO, Carpenteria, Calif.). Cells are stained for viability (>90%) by Trypan blue staining.

Subsequent to viable bone cell isolation above, bone cells (primarily osteoblasts or osteoclasts) are incubated in vitro with anti-Wise antibody-containing liposomes. An aliquot of anti-Wise-liposome-bone cells are then lysed. Polypeptide molecules of the elysate are separated and characterized by SDS gel electrophoresis and Western blot analysis. Reduction of Wise binding to LRP in the presence of anti-Wise antibody in bone cells can be measured.

It is predicted that anti-Wise antibody and anti-Wise Fab fragment molecules will both inhibit binding of wild type Wise to LRP5 in osteoblasts in vitro. In contrast, anti-Wise antibodies and fragments should not bind to osteoclasts, nor assert an effect on osteoclast activity (e.g., bone resorption). Correspondingly, based in part upon results described in Example 16 herein, it is expected that anti-Wise inhibition of Wise binding to LRP5 will result in increased growth and number of osteoblasts. Such increase in osteoblast number has previously been associated with concomitant increases in bone deposition and bone mineral density in vivo, as described in Example 16. Thus, treatment with anti-Wise liposomes is predicted to result in increased bone deposition and bone mineral density in in vivo mouse studies.

Example 40

The present Example relates to in vivo treatment of nude mice implanted with murine bone cells (e.g., osteoblasts, osteoclasts) with anti-Wise antibody-containing liposomes. Congenitally athymic nude mice containing murine bone fragment implants can be used as a test system for assessing the anti-Wise antibody-containing liposomes on murine bone cell growth in vivo according to the procedure described herein.

Congenitally athymic homozygous CD-1 female nude scid/scid mice (SCID, Charles River Laboratories, Wilmington, Mass.) are housed in sterile cages, treated with antibiotics and give autoclaved food and water. At approximately 6-8 weeks old, SCID mice can be injected subcutaneously with cut fragments of femurs and tibias of allotypically different murine fetuses or immature pups. Balb/c mice can be used as bone donors. Intraperitoneal injection of mice with bone fragment marrow implants is an alternative rout of administration. These mice may now be referred to as "SCID-bone mice."

Murine implanted bone fragment marrow grafts are allowed to "take" for approximately 6-8 weeks prior to injection with anti-Wise antibodies. Fetal donor bone cell suspensions are analyzed for murine allotypic markers.

As previously described herein, Fab anti-Wise antibody-containing liposomes can be prepared. $0.5–5.0 \times 10^6$ bone osteoblast cells are suspended in 20 ml of complete RPMI-1640 medium and injected with a Hamilton microliter syringe into each of the 6-8 week old murine bone marrow grafts of the SCID-bone mice. In the first experiment, Fab anti-Wise antibody liposomes (200:1; 100:1, 50:1 liposome:cell ratios) can be mixed together with bone cells prior to injection in vivo. In the second experiment, bone cells can be injected into the bone fragment marrow grafts, then anti-Wise antibody-containing anti-osteoblast antibody-armed liposomes (200:1; 100:1; 50:1 liposome:cell ratios) can be injected by several routes: (1) directly into the murine bone marrow, 4, 6, and 24 hr after murine bone fragment implantation; and (2) intravenously in the mouse tail vein at 0, 4, 6, and 25 hr after murine fragment implantation. Alternatively, and perhaps preferably, anti-Wise antibody-liposomes may be mixed with osteoblasts or osteoclasts prior to placement in operably contact with the implanted bone fragment. Controls would include anti-Wise antibody-containing liposomes wherein the attached arming antibody lacks osteoblast-binding specificity, and liposomes lacking anti-Wise antibody.

The effect of anti-Wise antibody-liposome treatment on bone cells can then be assessed by the following procedure. Growth of bone cells (i.e., osteoblasts, osteoclasts) can be analyzed by examining cells harvested from SCID-bone mouse bone fragment marrow implants at 1, 2, 4, 8, 16, and 32 weeks after anti-Wise antibody-liposome injection. Harvested cells can be analyzed by flow cytometry in the FACS-can system after suspension in complete RPMI-1640 medium, washing in RPMI, lysing of red blood cells with ammonium chloride, and staining with immunofluorescent reagents. Immunofluorescence sandwich markers including fluorescein- or rhodamine-conjugated goat anti-mouse IgG (H & L) antibody can be used in conjunction with murine monoclonal anti-Wise anti-body. Histological sections of bone, bone marrow, spleen, lymph node, lung and other tissue can also be prepared 1, 2, 3, and 4 months after bone cell implantation, sectioned, and stained with immunofluorescence reagents described above or with hematoxylin and cosin-stained formalin-fixed and paraffin-embedded specimens compared with specimens from untreated, control SCID-bone mice in which no osteoblast or osteoclast cells are injected. Significantly, SCID-bone mice may be analyzed for treatment with anti-Wise antibody-liposomes to determine efficacy of such liposomes to increase in growth and number of osteoblasts which is expected to result in increased bone deposition in this in vivo SCID nude mouse model system. Moreover, SCID-bone mice may be used to assess anti-human Wise antibody treatment effects utilizing xenogeneic human bone fragment transfers into such SCID-bone mice as described herein.

Example 41

This Example relates to injection of anti-Wise antibodies into the pups of the C57BL/6 mouse strain to determine their positive effects on Wise-regulated phenotypes. Alternatively, the 129 mouse strain may be used. Monoclonal and polyclonal anti-Wise antibodies specific for wild type Wise polypeptide molecules were made as described in Example 31 above. The antibody can be directed to the cysteine knot-containing region of Wise. Similarly, anti-Sost antibodies may be injected into mouse pups to determine phenotypic and therapeutic changes.

In this procedure, C57BL/6 mouse pups are injected with therapeutic doses of anti-Wise antibody in a pharmaceutical carrier such as sterile endotoxin-free phosphate buffered saline (PBS) at 2, 4, 6, 8, 10, 12, 14, 16, 18, and 20 days post partum. Alternatively, anti-Wise antibody Fab fragments may be used in a suitable pharmaceutical carrier medium. Bone mineral density of injected mice is compared to that of uninjected control mice as described in Example 16. It is anticipated that anti-Wise antibody treatment will result in increased bone mineral density and increased bone deposition in injected mice as compared to controls.

It is also predicted that anti-Wise antibody treatment will result in phenotypic changes in eyes and teeth as described in Wise mutant mice in Examples 15 and 17 above. Thus, anti-Wise antibody injected mice are expected to exhibit loss of optic nerve fibers and increased rod and cone layers in the retina as shown in Example 15 in Wise mutant mice. Anti-Wise antibody injected mice are predicted to manifest molar and incisor tooth abnormalities similar to those of Wise mutant mice as demonstrated in Example 17. An additional incisor tooth phenotype not present in the wild type mouse may be observed. In addition, anti-Wise antibody injected mice may show an additional M1 molar tooth, with an additional associated root. Anti-Wise antibody injected mice may also exhibit reverse orientation patterning of molar teeth, with possible fusion of M1 and M2 teeth.

Example 42

In this Example, kit components for detection and quantitation of Wise wild type and mutant polypeptides and fragments are described. Immunodiagnostics methodologies utilized in these kits are modifications of general and specific principles well known in the art. E. Harlow and D. Lane, Antibodies: A Laboratory Manual, Cold Spring Harbor Laboratory, New York, 1988, and E. T. Maggio, Ed., Enzyme-Immunoassay, CRC Press, Florida, 1980 are incorporated by reference herein.

Sandwich enzyme immunoassay kit components are as follows: 96-well microtiter plates coated with anti-Wise antibody, diluent buffer, Wise standards, horseradish peroxidase (HRP)-conjugated mouse anti-Wise antibody, ortho-phenylenediamine (OPD) substrate solution, containing $H_2O_2$, and 2N sulfuric acid stop solution.

Competitive enzyme immunoassay kit components are as follows: 96-well microtiter plates coated with wild type or variant Wise molecules, diluent buffer, Wise wild type and variant standards, horseradish peroxidase (HRP)-conjugated mouse anti-Wise antibody, ortho-phenylenediamine (OPD) substrate solution, containing $H_2O_2$, and 2N sulfuric acid stop solution. Similarly, Sost immunoassay kits may be prepared by substituting anti-Sost antibody for anti-Wise antibody, and Sost standards for Wise standards as components in the above described Wise kit.

Example 43

In this Example, an immunoprecipitation protocol and subsequent Western Blot protocol are described for analysis and characterization of various Wise-derived proteins and polypeptide molecules. Similarly, immunoprecipitation and Western blot analysis and characterization may be executed for Sost-derived proteins and polypeptide molecules. Western blot kits based on the methodology described herein may also be produced.

Western blot kits will contain the following components: Wise-derived protein and polypeptide molecule standards, primary goat antibody against Wise, secondary alkaline phosphatase-conjugated anti-goat antibody, blocking buffer, diluent buffer, and substrate development solution.

The immunoprecipitation protocol involves a technique for separation of Wise-derived polypeptide molecules from whole cell lysates or cell culture supernatants. Wise-derived polypeptide molecules may be wild type or mutant molecules; and these molecules may be obtained from mammalian cell cultures (e.g., osteoblasts) or from bacterial cells (e.g., *E. coli*) or mammalian cells. After immunoprecipitation binding to anti-Wise antibody and separation of these Wise-derived polypeptide molecules, the Wise molecules can be identified, biochemically characterized, and expression levels quantitated. Sost-derived polypeptide molecules may be similarly immunoprecipitated.

In initial immunoprecipitation runs, approximately 5-10 µg of anti-Wise-derived polypeptide molecule antibody is added to an Eppendorf tube containing the cold precleared lysate containing Wise polypeptides. Alternatively, antibodies recognizing the MYC tag may be utilized for these immunoprecipitations of Wise polypeptides. Reduced and nonreduced Wise-derived polypeptide molecules are prepared to run alongside prestained molecular weight standards for use on SDS-PAGE gels.

In the R&D System Immunostaining procedure, Western Blot membranes are blocked in Blocking Buffer, incubated with primary goat anti-Wise polypeptide antibody, incubated with secondary antibody (e.g., alkaline phosphatase conjugated anti-goat IgG antibody), incubated with Substrate Development solution, dried, and blocked in Blocking Buffer. Block unoccupied protein binding sites on membrane by placing membrane in Blocking Buffer on a rocker/shaker. Primary antibody (e.g., goat anti-Wise polypeptide molecule antibody) in Diluent Buffer is added to the membrane and incubated. After washing, incubate blots with 20 mL of secondary antibody (e.g., TAGO alkaline phosphatase-conjugated rabbit anti-goat IgG antibody) in Diluent Buffer and incubated. Wash membranes, incubate and then add Substrate Development Solution to membrane. Stop substrate development after incubation by pouring off Development Solution and rinsing membrane in deionized water.

In summary, this Western blot methodology can be used to identify, biochemically and immunologically characterize, and quantitate Wise and Sost polypeptide molecules derived from wild type and/or mutants in both mammalian and bacterial cell culture systems. In addition, Western blot kits may be produced utilizing Wise-derived and Sost-derived molecule standards, antibodies, and kit components described and utilized in the above-described methodology.

Example 44

In this Example, hybridization kits are described for the detection of Wise wild type and Wise variant nucleic acid sequences. Wise wild type and variant nucleic acid sequence molecules are prepared by either PCR methodology [Mullis, U.S. Pat. No. 4,683,195; Mullis, U.S. Pat. No. 4,683,202], including real time PCR techniques, or conventional cloning technology as described in Examples 19-20. Probe nucleic acid sequences can be produced in vectors as described previously. As alternatives to PCR methodology, isothermal techniques [Guatelli et al., Proceeding of the National Academy of Science 87: 1874-1878 (1990)], transcription based methods [Kwoh et al., Proceedings National Academy of Science 86: 1173-1177 (1989)], and QB replicase techniques [Munishkin et al., Nature 33: 473 (1988)] may be used. DNA or RNA primers are prepared containing desired Wise or Sost probe sequences. For example, a nucleic acid probe can be prepared to different portions of Wise nucleic acid sequences. Similarly, probes can be prepared for nucleic acid sequences that encode inactive Wise polypeptide variants that either do not bind to LRP5 or LRP6 or, alternatively, that, when inserted into mammalian cells, cause phenotypic increases in bone deposition or bone mineral density. [Kemp et al., Proceedings of the National Academy of Science 86: 2423-2427 (1989)].

Wise wild type molecule and Wise variant cDNA synthesis and DIG labeling is as follows: Heat 10-15 µg Wise sample RNA with 1.7 µl random primers (3 ug/ul; Invitrogen Cat. No. 48190-011) and 15.9 µl $H_2O$ at 70° C. Snap cool on ice and centrifuge. To each reaction tube, add DIG-dCTP. Add Master mix as follows: First Strand Buffer, DTT, dNTPs (25 mM each dA/G/TTP, 10 mM dCTP), SuperScript II (200 U/ul; Invitrogen Cat. No. 18064-014). Incubate reaction at 25° C., followed by 42° C. incubation.

While incubating the above reaction mixture, slides are prepared for hybridization as follows: Incubate the prehybridization solution in a Coplin jar at 63° C. to equilibrate. Place slides in the pre-heated solution and incubate at 63° C. Prepare two staining troughs, one with MilliQ $H_2O$ and the other with isopropanol. Place slides in slide rack and immerse in first trough to rinse in MilliQ $H_2O$ with vigorous shaking. Transfer the rack into the second trough and rinse in isopropanol. Dry slides by centrifugation on a microtiter plate rotor on absorbent cloth. Store slides in slide box prior to hybridization.

Briefly centrifuge the labeling reaction tubes. Add 10 µl 1N NaOH and heat at 70° C. to hydrolyze the RNA. Neutralize by adding 1 N HCl. Using the MinElute PCR purification kit (Qiagen Cat. No. 28004), combine DIG-labeled cDNA samples in a single Eppendorf tube and add Buffer PB. Apply to MinElute column in collection tube and centrifuge. Purple coloration of the membrane indicates efficient labeling of both cDNA samples. Add 50 µl Buffer PE to MinElute column and centrifuge to dry the membrane. Add 10 µl MilliQ $H_2O$ pH 7-8.5 carefully to the center of the membrane and allow to stand for 1 min. Centrifuge to collect cDNA (yield ~80%). Place the MinElute column into a fresh tube B. Add MilliQ $H_2O$ pH 7-8.5 to the center of the membrane and allow to stand for 1 min. Centrifuge at 13,000 rpm for 1 min to collect residual cDNA. Transfer 4.5 µl from tube B to tube A (final volume 14.5 µl).

For hybridization, the following procedure is used: Mix purified DIG sample with hybridization solution (DIG-labeled cDNA, filtered 20×SSC, filtered 2×SDS). Prepare a slide heating block. Preheat the hybridization chamber. Heat hybridization solution at 99° C. for 2 min to denature cDNA. In the meantime, prepare the slide and a 24×24 mm coverslip. When ready, immediately centrifuge the hybridization solution briefly, put the slide into the chamber, pipet SSC into each of the two wells of the chamber, and apply the solution onto the slide at the edge of the spotted area avoiding bubble formation by using curved-edge fine forceps to set the coverslip in place. Close the chamber and immerse it in a 63° C. waterbath. Incubate chambers overnight.

Transfer slides one at a time from the chamber to the Coplin jar containing Wash A and let the coverslip fall off by gently moving the slide vertically in the solution. Once the coverslip is removed, transfer the slide quickly to the rack in the trough of Wash A. When all slides are on the rack, wash by vigorous agitation for 5 min at room temperature. Transfer the slides quickly to the rack in the second trough containing Wash B. Wash by vigorous agitation for 3 min at room temperature. Transfer the rack to the third trough containing Wash B and wash by vigorous agitation for 3 min at room temperature. Dry slides and store in a slide box until scanning.

The ScanArray Express (Perkin Elmer Life Sciences, Boston, Mass.) can be used to scan the slides. Alternatively, the Image Trak Eip-Fluorescence System (Perkin Elmer Life Sciences, Boston, Mass.) can be used for 96,384, or 1536 well plates.

In summary, hybridization methodology and kits for the detection, identification, and quantification of Wise-associated nucleic acid sequences in cells are set forth herein. Using these methods, Wise wild type and mutant nucleic acid sequences can be identified, characterized, and quantified. In addition, kits may be produced utilizing Wise-derived nucleic acid molecule standards, antibodies, and kit components as described in the above methodology.

REFERENCE LIST

Amaya, E., Musci, T. J., and Kirschner, M. W. (1991). Expression of a dominant negative mutant of the FGF receptor disrupts mesoderm formation in *Xenopus* embryos. Cell 66, 257-70.

Axelrod, J. D., Miller, J. R., Shulman, J. M., Moon, R. T., and Perrimon, N. (1998). Differential recruitment of Dishevelled provides signaling specificity in the planar cell polarity and Wingless signaling pathways. Genes Dev. 12, 2610-2622.

Baker, J. C., Beddington, R. S., and Harland, R. M. (1999). Wnt signaling in *Xenopus* embryos inhibits bmp4 expression and activates neural development. Genes Dev 13, 3149-59.

Beddington, R., and Robertson, E. (1998). Anterior patterning in mouse. Trends in genetics 14, 277-284.

Beddington, R., and Robertson, E. (1999). Axis development and early asymmetry in mammals. Cell 96, 195-209.

Blumberg, B., Bolado, J., Moreno, T., Kintner, C., Evans, R., and Papalopulu, N. (1997). An essential role for retinoid signaling in anteroposterior neural patterning. Development 124, 373-379.

Bork, P. (1993). The modular architecture of a new family of growth regulators related to connective tissue growth factor. FEBS 327, 125-130.

Bourguignon, C., Li, J., and Papalopulu, N. (1998). XBF-1, a winged helix transcription factor and dual activity, has a role in positioning neurogenesis in *Xenopus* competent ectoderm. Development 125, 4889-900.

Bradley, L., Sun, B., Collins-Racie, L., LaVallie, E., McCoy, J., and Sive, H. (2000). Different activities of the frizzled-related proteins frzb2 and sizzled2 during *Xenopus* anteroposterior patterning. Dev Biol 227, 118-32.

Brannon, M., Gomperts, M., Sumoy, L., Moon, R. T., and Kimelman, D. (1997). A β-catenin/XTcf-3 complex binds to the siamois promoter to regulate dorsal axis specification in *Xenopus*. Genes Dev. 11, 2359-2370.

Cadigan, K. M., and Nusse, R. (1997). Wnt signaling: a common theme in animal development. Genes Dev 11, 3286-305.

Capdevila, J., Tabin, C., and Johnson, R. L. (1998). Control of dorsoventral somite patterning by Wnt-1 and ∃-catenin. Dev Biol 193, 182-94.

Christian, J. L., and Moon, R. T. (1993). Interactions between XWnt-8 and Spemann organizer signaling pathways generate dorsoventral pattern in the embryonic mesoderm of *Xenopus*. Genes Dev. 7, 13-28.

Condie, B. G., Brivanlou, A. H., and Harland, R. M. (1990). Most of the homeobox-containing Xhox 36 transcripts in early *Xenopus* embryos cannot encode a homeodomain protein. Mol. Cell. Biol. 10, 3376-3385.

Cox, W. G., and Hemmati-Brivanlou, A. (1995). Caudalization of neural fate by tissue recombination and bFGF. Development 121, 4349-4358.

Danielian, P. S., and McMahon, A. P. (1996). Engrailed-1 as a target of the Wnt-1 signalling pathway in vertebrate midbrain development. Nature 383, 332-4.

Dickinson, M. E., Selleck, M. A., McMahon, A. P., and Bronner-Fraser, M. (1995). Dorsalization of the neural tube by the non-neural ectoderm. Development 121, 2099-106.

Doniach, T. (1993). Planar and vertical induction of anteroposterior pattern during the development of the amphibian central nervous system. J. Neurobiology 24, 1256-1275.

Ensini, M., Tsuchida, T., Belting, H.-G., and Jessell, T. (1998). The control of rostrocaudal pattern in the developing spinal cord: Specification of motor neuron subtype identity is initiated by signals from paraxial mesoderm. Development 125, 969-982.

Fagotto, F., Guger, K., and Gumbiner, B. M. (1997). Induction of the primary dorsalizing center in *Xenopus* by the Wnt/GSK/∃-catenin signaling pathway, but not by Vgl, Activin or Noggin. Development 124, 453-460.

Fan, M. J., and Sokol, S. Y. (1997). A role for Siamois in Spemann organizer formation. Development 124, 2581-2589.

Fredieu, J. R., Cui, Y., Maier, D., Danilchik, M. V., and Christian, J. L. (1997). XWnt-8 and lithium can act upon either dorsal mesoderm or neurectodermal cells to cause a loss of forebrain in *Xenopus* embryos. Developmental Biology 186, 100-114.

Gavalas, A., and Krumlauf, R. (2000). Retinoid signalling and hindbrain patterning [In Process Citation]. Curr Opin Genet Dev 10, 380-6.

Glinka, A., Wu, W., Delius, H., Monaghan, A. P., Blumenstock, C., and Niehrs, C. (1998). Dickkopf-1 is a member of a new family of secreted proteins and functions in head induction.

Glinka, A., Wu, W., Onichtchouk, D., Blumenstock, C., and Niehrs, C. (1997). Head induction by simultaneous repression of Bmp and Wnt signalling in *Xenopus*. Nature 389, 517-519.

Gould, A., Itasaki, N., and Krumlauf, R. (1998). Initiation of rhombomeric Hoxb4 expression requires induction by somites and a retinoid pathway. Neuron 21, 39-51.

Grapin-Botton, a., Bonnin, M.-A., and Le Douarin, N. (1997). Hox gene induction in the neural tube depends on three parameters: competence, signal supply and paralogue group. Development 124, 849-859.

Hamburger, V., and Hamilton, H. L. (1951). A series of normal stages in the development of the chick embryo. J. Morph. 88, 49-92.

He, X., Saint-Jeannet, J. P., Wang, Y., Nathans, J., Dawid, I., and Varmus, H. (1997). A member of the Frizzled protein family mediating axis induction by Wnt-5A. Science 275, 1652-4.

Heasman, J., Kofron, M., and Wylie, C. (2000). ∃-catenin signaling activity dissected in the early *Xenopus* embryo: a novel antisense approach. Dev Biol 222, 124-34.

Heisenberg, C. P., Tada, M., Rauch, G. J., Saude, L., Concha, M. L., Geisler, R., Stemple, D. L., Smith, J. C., and Wilson, S. W. (2000). Silberblick/Wnt11 mediates convergent extension movements furing zebrafish gastrulation. Nature 405, 76-81.

Hemmati-Brivanlou, A., Kelly, O. G., and Melton, D. A. (1994). Follistatin, an antagonist of activin, is expressed in the Spemann organizer and displays direct neuralizing activity. Cell 77, 283-95.

Hemmati-Brivanlou, A., and Melton, D. (1997). Vertebrate embryonic cells will become nerve cells unless told otherwise. Cell 88, 13-7.

Hemmati-Brivanlou, A., and Melton, D. a. (1994). Inhibition of activin receptor signaling promotes neuralization in *Xenopus*. Cell 77, 273-81.

Hoppler, S., Brown, J. D., and Moon, R. T. (1996). Expression of a dominant-negative Wnt blocks induction of MyoD in *Xenopus* embryos. Genes Dev. 10, 2805-2817.

Hsieh, J.-C., Kodjabachian, L., Rebbert, M. L., Rattner, A., Smallwood, P. M., Samos, C. H., Nusse, R., Dawid, I. B., and Nathans, J. (1999). A new secreted protein that binds to Wnt proteins and inhibits their activities. Nature 398, 431-436.

Itaskai, N., Sharpe, J., Morrison, A., and Krumlauf, R. (1996). Reprogramming Hox expression in the vertebrate hindbrain: Influence of paraxial mesoderm and rhombomere transposition. Neuron 16, 487-500.

Itoh, K., and Sokol, S. (1997). Graded amounts of *Xenopus* dishevelled specify discrete anteroposterior cell fates in prospective ectoderm. Mechanism of Development 61, 113-125.

Itoh, K., and Sokol, S. Y. (1999). Axis determination by inhibition of Wnt signaling in *Xenopus*. Genes Dev 13, 2328-36.

Itoh, K., Tang, T. L., Neel, B. G., and Sokol, S. Y. (1995). Specific modulation of ectodermal cell fates in *Xenopus* embryos by glycogen synthase kinase. Development 121, 3979-3988.

Jones, C. M., and Smith, J. C. (1999). An overview of *Xenopus* development. Methods in Molecular Biology 97, 331-340.

Jones, C. M., and Smith, J. C. (1999). Wholemount in situ hybridization to *Xenopus* embryos. Methods in Molecular Biology 97, 635-640.

Joyner, A. L. (1996). Engrailed, Wnt and pax genes regulate midbrain-hindbrain development. Trends Genet. 12, 15-20.

Kintner, C. (1992). Molecular bases of early neural development in *Xenopus* embryos. Ann. Rev. Neurosci. 15, 251-284.

Kolm, P., Apekin, V., and Sive, H. (1997). *Xenopus* hindbrain patterning requires retinoid signaling. Developmental Biology 192, 1-16.

Kreig, P., and Melton, D. (1988). In vitro RNA synthesis with SP6 RNA polymerase. In Methods in Enzymology: Recombinant DNA techniques, S. Berger and A. Kimmel, eds.: Academic Press), pp. 397-415.

Lamb, T. M., and Harland, R. M. (1995). Fibroblast growth factor is a direct neural inducer, which combined with noggin generates anterior-posterior neural pattern. Development 121, 3627-3636.

Lee, K. J., and Jessell, T. M. (1999). The specification of dorsal cell fates in the vertebrate central nervous system. Annu Rev Neurosci 22, 261-94.

Leyns, L., Bouwmeester, T., Kim, S. H., Piccolo, S., and DeRobertis, E. M. (1997). Frzb-1 is a secreted antagonist of Wnt signaling expressed in the Spemann organizer. Cell 88, 747-56.

Liem, K. F., Jr., Tremml, G., and Jessell, T. M. 1997). A role for the roof plate and its resident TGF ∃-related proteins in neuronal patterning in the dorsal spinal cord. Cell 91, 127-38.

Liem, K. F., Jr., Tremml, G., Roelink, H., and Jessell, T. M. (1995). Dorsal differentiation of neural plate cells induced by BMP-mediated signals from epidermal ectoderm. Cell 82, 969-79.

Lin, X., and Perrimon, N. (1999). Dally cooperates with *Drosophila* Frizzled2 to transduce Wingless signalling. Nature 400, 281-284.

Lu, J., Chuong, C., and Widelitz, R. (1997). Isolation and characterization of chicken 3-catenin. Gene 196, 201-207.

Lumsden, A., and Krumlauf, R. (1996). Patterning the vertebrate neuraxis. Science 274, 1109-1115.

McGrew, L. Hoppler, S., and Moon, R. (1997). Wnt and FGF pathways cooperatively pattern anteroposterior neural ectoderm in *Xenopus*. Mechanisms of Development 69, 105-114.

McGrew, L., Lai, C.-J., and Moon, R. (1995). Specification of the anteroposterior neural axis through synergistic interaction of the Wnt signalling cascade with noggin and follistatin. Developmental Biology 172, 337-342.

McGrew, L., Takemaru, K., Bates, R., and Moon, R. (1999). Direct regulation of the *Xenopus* engrailed-2 promoter by the Wnt signaling pathway, and a molecular screen for Wnt-responsive genes, confirm a role for Wnt signaling during neural patterning in *Xenopus*. Mechanism of Development 87, 21-32.

McMahon, A. P., Joyner, A. L., Bradley, A., and McMahon, J. A. (1992). The midbrain-hindbrain phenotype of Wnt-1-/Wnt-1-mice results from stepWise deletion of engrailed-expressing cells by 9.5 days postcoitum. Cell 69, 581-95.

Moon, R. T., Brown, J. D., Yang-Snyder, J. A., and Miller, J. R. (1997). Structurally related receptors and antagonists compete for secreted Wnt ligands. Cell 88, 725-8.

Muhr, J., Graziano, E., Wilson, S., Jessell, T., and Edlund, T. (1999). Convergent inductive signals specify midbrain, hindbrain, and spinal cord identity in gastrula stage chick embryos. Neuron 23, 689-702.

Muhr, J., Jessell, T., and Edlund, T. (1997). Assignment of early caudal identity to neural plate cells by a signal from caudal paraxial mesoderm. Neuron 19, 487-502.

Munsterberg. A. E., Kitajewski, J., Bumcrot, D. A., McMahon, A. P., and Lassar, A. B. (1995). Combinatorial signaling by Sonic hedgehog and Wnt family members induces myogenic bHLH gene expression in the somite. Genes Dev 9, 2911-22.

Nieuwkoop, P. (1952). Activation and organisation of the central nervous system in mphibians. J. Exp. Zool. 120, 1-108.

Pera, E. M., and DeRobertis, E. M. (2000). A direct screen for secreted proteins in *Xenopus* embryos identifies distinct activities for the Wnt antagonists Crescent and Frzb-1. Mech Dev 96, 183-95.

Piccolo, S., Agius, E., Leyns, L., and Bhattacharyya, S. (1999). The head inducer Cerberus is a multifunctional antagonist of Notal, BMP and Wnt signals. Nature 397, 707-710.

Piccolo, S., Sasai, Y., Lu, B., and DeRobertis, E. M. (1996). Dorsoventral patterning in *Xenopus*: inhibition of ventral signals by direct binding of chordin to BMP-4. Cell 86, 589-98.

Pinson, K. I., Brennan, J., Monkley, S., Avery, B. J., and Skarnes, W. C. (2000). An LDL-receptor-related protein mediates Wnt signalling in mice. Nature 407, 535-538.

Pownall, M. E., Isaacs, H. V., and Slack, J. M. (1998). Two phases of Hox gene regulation during early *Xenopus* development. Curr Biol 8, 673-6.

Pownall, M. E., Tucker, A. S., Slack, J. M., and Isaacs, H. V. (1996). eFGF, Xcad3 and Hox genes form a molecular pathway that establishes the anteroposterior axis in *Xenopus*. Development 122, 3881-92.

Rasmussen, J. T., Deardorff, M. A., Tan, C., Rao, M. S., Klein, P. S., and Vetter, M. L. (2001). Regulation of eye development by frizzled signaling in *Xenopus*. Proc Natl Acad Sci USA 98, 3861-6.

Rothberg, J. M., Jacobs, J. R., Goodman, C. S., and Artavanis-Tsakonas, S. (1990). slit: an extracellular protein necessary for development of midline glia and commissural axon pathways contains both EGF and LRR domains. Genes Dev 4, 2169-87.

Ruiz i Altaba, A. (1994). Pattern formation in the vertebrate neural plate. TINS 17, 233-243.

Salic, A. N., Kroll, K. L., Evans, L. M., and Kirschner, M. W. (1997). Sizzled: a secreted XWnt8 antagonist expressed in the ventral marginal zone of *Xenopus* embryos. Development 124, 4739-4748.

Tada, M., and Smith, J. (2000). XWnt11 is a target of *Xenopus* Brachyury: regulation of gastrulation movements via Dishevelled, but not through the canonical Wnt pathway. Development 127, 2227-2238.

Tamai, K., Semenov, M., Kato, Y., Spokony, R., Lui, C., Katsuyama, Y., Hess, F., Saint-Jeannet, J.-P., and He, X. (2000). LDL-receptor-related proteins in Wnt signal transduction. Nature 407, 530-535.

Trainor, P., and Krumlauf, R. (2000). Plasticity in mouse neural crest cells reveals a new patterning role for cranial mesoderm. Nature Cell Biology 2, 96-102.

Tsuda, M., Kamimura, K., Nakato, H., Archer, M., Staatz, W., Fox, B., Humphrey, M., Olson, S., Futch, T., Kaluza, V., Siegfried, E., Stam, L., and Selleck, S. B. (1999). The cell-surface protteoglycan Dally regulates Wingless signalling in *Drosophila*. Nature 400, 276-280.

Vleminckx, K., Kemler, R., and Hecht, A. (1999). The C-terminal transactivation domain of ∃-catenin is necessary and sufficient for signaling by the LEF-1/∃-catenin complex in *Xenopus laevis*. Mech Dev 81, 65-74.

von Heijne, G. (1986). A new method for predicting signal sequence cleavage sites. Nucleic Acid Research 14, 4683-4690.

Wallingford, J. B. Rowning, B. A., Vogeli, K. M., Rothbacher, U., Fraser, S. E., and Harland, R. M. (2000). Dishevelled controls cell polarity during *Xenopus* gastrulation. Nature 405, 81-5.

Wang, S., Krinks, M., Lin, L., Luyten, F. P., and Moos, M., Jr. (1997). Frzb, a secreted protein expressed in the Spemann organizer, binds and inhibits Wnt-8. Cell 88, 757-66.

Wehrli, N., Dougan, S. T., Caldwell, K., O'Keefe, L., Schwartz, S., Vaizel-Ohayon, D., Schejter, E., Tomlinson, A., and DiNardo, S. (2000). Arrow encodes an LDL-receptor-related protein-essential for Wingless signalling. Nature 407, 527-530.

Thus, there has been shown and described novel methods and compositions related to Wise, Sost, and LRP, which influence ocular development, bone deposition, Wnt pathway, and tooth development, which fulfills all the objects and advantages sought therefore. It is apparent to those skilled in the art, however, that many changes, variations, modifications, and other uses and applications for the subject methods and compositions are possible, and also such changes, variations, modifications, and other uses and applications which do not depart from the spirit and scope of the invention are deemed to be covered by the invention, which is limited only by the claims which follow.

SEQUENCE LISTING (140 sequences)

SEQ ID NO: 1 - DNA, 618 bp, MOUSE
  misc_feature: wise cDNA
  misc_feature (283)..(283): n is a, c, g, or t
  misc_feature (383)..(383): n is a, c, g, or t
atgcttcctcctgccattcatctctctctcattcccctgctctgcatcctgatgagaaactgtttggcttttaaaaatgatgccacagaaatcctttattcacatgtggttaaacctgtcccggcacaccccagcagcaacagcaccctgaatcaagccaggaatggaggcaggcatttcagtagcactggactggatcgaaacagtcgagttcaagtgggctgcagggaactgcggtccaccaaatacatttcggacggccagtgcaccagcatcagccctntgaaggagctggtgtgcgcgggcgagtgcttgcccctgccggtgcttcccaactggatcggaggaggctatggaacaaagtactggagccggaggagctntcaggagtggcggtgtgtcaacgacaagacgcgcacccagaggatccagctgcagtgtcaggacggcagcacgcgcacctacaaaatcaccgtggtcacggcgtgcaagtgcaagaggtacacccgtcagcacaacgagtccagccacaactttgaaagcgtgtcgcccgccaagcccgcccagcaccacagagagcggaagagagccagcaaatccagcaagcacagtctgagc

SEQ ID NO: 2 - DNA, 3311 bp, Homo sapiens
tatataaagggaagcttgaggaggaatttcacagttacagtgcagaagcagaagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacagtaagtgtgttttacttgtacagtttttttttttcttttctggtagcattagctcacattcctgtagaattgttttattggtaactaacctgaaccgtatatatgttgtgaaacaatttgggagtaatctgctgcatgtgcaggttggcattcttccctaggtagtgattttaaagttaacctaactaaaacagtggtttaatagtgcaagcacagactgaagttttatcaaacatccacaaagaaaacatttccaggaattaaactattgttttgtcaaaatcatgcaaaatgaccattttaaaaagtattgttttagatagctcaagttccggttgttttgtcaatttatttcagggcatatgcaattttggtaaagtgtataaacgtaactaatatatattattagttaccatccacaaataaatatagggaatcacaagggaaaaaaggaagcttccaggagaaaaaatttgtttacattggatttctaaaatatgtctagtgagatagtcaaaagttttgatgatgctcaatgtaaaagagggataaactaaaaatgttggagaatcacatttttctaaaataattccttgttgtcccattcaaaatttagataattgtgtatttctgtgacagactggggacatttttgtaacttaagagatgtaaaacaacagcttagttgacacactaattgaccactggttagggggattcaaattacccctaacttttgtttctatcttttcctttagaagaggccatatgctaataatcaggttttaagagagagagagagagagagagaaacactgcgcaggaaatcttacacaaatcttttgcctctccttcttcactccattcaactacgaaaagtagttttgacttttgaaaagtcaaagcaaatttgactgttaatgtctaagaaagctaggatgttttaactttcacgaagctggttgcttttaagtacacaggacatatctgattattattagattactgagcaatgtggtgggtattcgttgtcaatgaactgtcactgcaaaaatgccaaatctgtatatacacaggaacagaaagcttgacgagacaaaattatttctggctatttccaggtgcattcctgaggcagctgcaggaaggtgagctggaggcagaatcaggcacgctgagcacactgtccaaccaaacaatttacgctttacattttaatcccacaattctagatttctatgcatgcatgtctatatacataagtttttccacaactatcacgttccccttaagctatatctcttacctcagaagtactagcatacagagatgaagtgaaactcctgattcagttctacttcgacgtatctttcagtactttttgtggaaccacttcagtgtcccttatcatttttatttgtaaaatgtcagcagcctgtacttttaaacatcctttttttttttcctggttggcaagccttgatttcttttcaagcttgttataggcaattctcctcaagtttagataacaaagcaagggtaaggaaaacttaaaatatttaaagattaatttttgctttaattacataaggcatgtaacaagaaacagccaattagagaacatacctatcaaatccaaataactaaaacaaaaagtttgccatgaccaatattcaggaaatgaacaccgtggttccttttgcagttgtaaatcagacatgttaggcatttttctgccataaaattcatggaaatgtagccaagttgttatggcaaccatacgttcctgatttaggggcttttatattctttgagtcttgagttgtagtggcattttacatttcaaacatgttactgtttgtattttttaaaagatagtttgggaatttatgtttaaaacatagttattaagtttgatatgcaaaatgtcagatgttgtacacatgtatgtctgagtctctgcagctaaagtctataattgaaataaaatattaccgagagcatatgcattatacacaatatttaaatggctatcacattttttctcaacagatttttaaaaagcctaattaaaaacacttgcagacattagccaatatgacccttgagaaagagaatattaaagtatactcttaactcattgaataatgaatatttacacataaatggaagagctgctaaccccttattggagagtcagactaaggaaattggattttcaaacactctaataagcaattagctaatgttatatataaaaacaatcaggcctacattttttttcccaaaaaagttatagccatgtaaactgatgattttcatgaaagtgtccctatactatccagacagatttttttcactgtgaaaataaagtaggtgctcactttctatttggcaatttgctatcatttgcctattatttttgtcattgcagatcactttttaaaaggtcttcatttgcattttttctctgatgcacattcttttttgtttcctgcagctcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttc

SEQ ID NO: 3 - DNA, 1873 bp, Homo sapiens
agggatcccaccccttctctgtgttttcactctgaagctctacacaactttacacctgaatgaacgccaaacctctatggatatataaagggaagcttgaggaggaatttcacagttacagtgcagaagcagaagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacactcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtataaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagttattgttgttgcctctaacatgtataaagggtgcaaaaattgtagaataaatgtataagggtaaaaaa

SEQ ID NO: 4 - DNA, 671 bp, CHICK
atgcttctctccgccattcacttctacggcttactcctagcttgcaccttcacgagaagctactcggctttcaagaacgatgccactgagatactttattcccacgtcgttaaacctgcccctgcgagcccgagcagcaacagcacgttgaaccaagccaggaacggagggaggcactacgccggcacgggctccgaccgtaacaatcgcgttcaagttggctgccgggaactgcgatctaccaagtacatctcagacggccagtgcaccagcatcaatcccctgaaggagctggtgtgtgctggcgaatgcctccccttgccgctcctgcccaactggattggaggaggttatggaaccaagtactggagcagacggagctcgcaagagtggagatgtgtcaatgacaaaactcgcacccagaggatccagctgcagtgccaggatggaagtataagaacctacaaaataactgtggtcacggcctgcaagtgcaagcgatacaccaggcagcacaacgagtccagccacaactttgagggaacctctcaagcaaagcctgtccagcatcacaaagagagaaaaagagccagtaaatccagcaaacatagtacaagttagaagtcagacgtcctctcctctcctgctcctcctgccaaaactgaactcac

SEQ ID NO: 5 - DNA, 5669 bp, Caenorhabditis elegans
ttaagcagtgtgttcgacaaatgccggtgcaggagtgacaacatcctggtgtggtggctcggttgaaatgtctccagcgttcgaagaagcgtcgctacctgacttggtacgttcacgcttcgttgcctgaaacatgtcacatatttgcatgaatagcaatagtttttgcaccatgtggaaatctaagaatctatgaagccagggcttccattccgccacagaaccccgaaagtgtcggccgctgccaaataactatttatcgcactacgttatgcaaacatcaagcatggcgtggagcgccgtcaccgtcaaaatcctagccagcagttgtagaaaatacaccaacctctccatcgctgctgctgctgttagtttgatcttcgtcctcttcctcctcgtggcagaacgtttcctgatcgttcaacgttttcttgttccatccacgaacttgctgtccgacactttgttggcgttccagagtgtttgatcgagatctcaaagtgtgtgcgtggtcgactgtaagctcatgtggcatgcatttcattggtgcacggaaatagtagaatgatggatagtgtacaaggttgtagcaagaagaagcgtagacgtcagcatatctgaaaatacccgtggtctttgcacttatttctatttttgggtaggttcagtcaaccgtgatgtcctaaaaatgtcatcaaaccgttgttttgaaagtttttatttactaaagggatattcttagagcaagagtaaaggttcgaataatttgaaacgcatgttgtttaaatgcgctcaaatgacaaaatttcaatgaaacttatcaaaaatttatcaaaaaagtgttatgcccgtttaaaagtttgaaaaaatggtcaaactttaacaaaacgctacagttgacttttttgatttactattatgtattggtattttgtaagccgataggtaactaaaaattacaaaaataagtcaactatcgcttcaaaggtaccttaaccaacgaaataatgtgagataaactaccaaaatatgcaataaaagacgataacttaaaaagtcaaccacgaaccgcgtggccgaaattggagattttagctaaaattaggttatttttatttgaaattttcaattgccataaaaactttatgaacatttttcaaaaagtttcattacgaaatttgttcatttgagcacattttggataaatacgttccaaatagttttagctgttactcctctttcaaacttttttcaggtttaatcaaacactaaaacttaaaaaaaaaacaaatttaaattctctattctagtgaatcaggtaaattacattttttaatcataaaaaactgaacactttagtgtatacttcttttgtatttttgccaaggaaacaccgttcccaaacctaattatcaagttatatacctttcgacttgagaggcaaagaaggtagttcggcctccggttctaaaaagacttcccaaacatccatactcctcgtccatttgattggtaagtttctggaagaaattgtgatttcacaaactttatccgtaaaataaatattgaacctactctaatcttatcaacgatgtccttgacgacaggcttatgacgagaagctccatccaaattcttatagatgtcagccaacgtgctctccatatgtcccatctcatcgaacaatggcttgctatcagtccacacagtcagctcgttaacaagctccggaacaactaggaaggtcctccatccgcgggatttcttcgagcgaagtacatctccgaaaatgtgatctccgacgtaaaggacctcctttccacggcatttcatcattttttggaaagcgtcacaggatcctccagaatagacgactccttctctgagcggtccagtatgaattccgagtttgtaggatccggtgtcagtgttgacttctctaaaaactgttccctctgcaaaccatctcggcttgcacgaatctacaactatgatgttgaagtaggtcttccagtcatctcccaaaataaacttcatcatcacattagtgtacgtccagtcgctgttggtgaggaggaatgttttcttgccgtgctctctgagctggctcaagaaacgtggtgcacgctcatcacgaatgacatacttctccggattttccattacttgctttttcatcgtgctctgaaaatctcatctatttagtttccggaaacaagacatttgagtctcacctccacatgaacccagtcaataactcgtctcaaatcttggaaaattgatttgtatgacatcatcacctcgccacctttcactcccgtcttatcagtgagcctggaatttattggaaaatgttgcagtggagctgcctatcttgtaaacttacatcgaataatgtggatgcttgtcaaagaagtcgataagttgacagataagatgagtctcgggcatgttgaacagcgtgttcaatacataaacccgcgagtcggacaatggtaggtacttgttcgggtacatctcctcgatttcatggctgcaaaattaatttttgcttgattatattgattatttaggcatactttttcaagaaacggagaccgtgaattcctccgagaatgtttccaaatccatcaactttgagcaaatttccgaattgaaactcgaaccacagacctgaaataatcaagcacactataataatcttttcttgcgactgattaaatatttaaagacgattacgcattgaatcgtaatcagaaacccataattcccggcttacaagacgattagcaacacctcgaccctgttttgaacctttgtaaaatctaataaagtcgaggtcaaattttctcccctgttacaaacaatccaacgattcaatgtgtgatgtcaaggaaaactggcgcttagacgttgttcgtcaaaagatttattgcagtgagataatgcgcagctatttttttattaagcgcataaaaattgtattcccttacaacaccaagatacaaaaagtttatgttcctgattcgcatgcaataaaaaaaactaattgacagtaccagcattctttcaagacgcgtgctataaaacacgtgagccactgaaacaaaccggaaatttcgcaacttaccacgaactgggaaaattggatcatatttgaaacttttgatttcttcaggataaccagtgtctacaagacgttggacagccatattgaatgccagatattccatatcaggagctttgtactctggaaaaaagacttgttggaatgctggactggttaatgtgcaatgaacttacgaacaagggtataatccatgtcgaatccaaagtgggtgattttctccaaccggagggaccggttaacgaataccctgtaacacagatttgatataaatttctcagaaataaaatattttgaatggcgttcttattttctaaactatgtttatgcaaaaagctacatcacaggtttgaaggaggtattacggatttgcgtattttaaacgtgtaggctcaaaatgtgtttaagtgaacgaatttcgtaatgacatctttcaaaaaaaatttcacaaacatttcatggcggttcaaaatttcgaaaaatttagcctaattctagctgaaatctgcaattttgggaccaaaaattacaaaacacctatggtcacctataggctttaaatgtgccatcaacgcagtaacgcgagataaactaccaaaatatgagataaaggataaaaatttgaaaaaaaagtcatcttcgaacggctgcgacagagtgactaaattcggagatattacctaattctgaacccccataaaaaaatttttgaaatattttttgaaatgtttcattttgaaattcatttatttgaacacattttgggctacatacccaaaaccgatactgctcctttaatctatacctttcgtctgcattggagtctttccagctaaccattttttaaatccttcagtgtatcttgataggagtaagccgtagaagtaagtttgtggctcagtttgtgaggcgccgaaaaataaaaagttttaatgattttgaaaatatatagagcaatcaaaccaaaaaaaaaagtgcaaaaaaattaggcagataataaagaaaactgagggaaagtattttcatcttcagtataccaaaagaaaattgataagacatgataacgaaggttgacacctgagaatttcttagtgagaaaaagtgggcagaccggggggaacaaacccaataaagaaattatcagtaagagtgaacttaaacctaggccagtggaaacacgacgcaattttagcgccttggaatgattccgcctatcgctaccattaaaagataggaagaggaggattggaaaacgctgcaacctcagaaaaccttgatgcgcatgagaaaaaattgatggataaattgaggaatgcacttttttgagagcgattattttaatgtggtagacagacccagtaaagaaataaccttgaatcttcagccaagtaaaacgaatctcgtaatattccacaactccacatcatagtattctaataccgaactgtcaccataaattatacatttctatttcactttgaaaaatcaaatttatacctacatatgacccattcacgcttggtggagcaataatttgcaaaacgaagcgaaaataggagtgaaatagaaaaaaaagaaaagaaaagaaaacgtgtaggggttagaatgaataaatacagggaggtaagaagttcgtgcagtttagttgagagcgaagcattctctcttctgctctcatgctcctatgagcatttcttgttaaacttgcttcttcgttgtttttttctgttgtctttttaggctcttggttccatcaaccctattacgaaggcgcgttctaaaatggatttttccaccattttttttcactaaaaacagcgccaaaaatgtgctagaacagcacaaaaatgattggtcaaaattatgaaaattatgaaaatcaacaaaaacgtagatctcagcctagggaaaaagcctagggaataagtacccacaatttaattttttctgatgcaatactaaatttatgaacaattttttaaaaagttgaataattgaagcggtagaaatttttttaagttctaaaaaagtatacaataatgtgtatttatttaaaagaatatcctttgaaggaggagtaacgggaaaaatttcggattgaattttttagaaaaaaaaattcaaaatttattatggtgatttatttcgcccacttttccgtgttgaagcggttggaagctaatttttttctgaattatcattctcttgttgcatattttggttgtttatctcacattattgtgtaaataaatgtatatttaaataaatatgcaataaaaaagataattcgaaaaaagtcagctccaatccgaaaaggtggccaatcaagatcggaaaatataaataaaactcggctgaaccgtcataaaaaaagttaaagtttgtcaattgagcgcattttggagctaggcgtgtgtataataaaattcacgaaaatatacacgtatgtttcctttttatagcaaaagtataattttttctgattttattgttctcacctttcagctgggttccttttgtaaagcgaacggtcggctgacat

SEQ ID NO: 6 - DNA, 3128 bp, MOUSE
atgcagccctcactagccccgtgcctcatctgcctacttgtgcacgctgccttctgtgctgtggagggccaggggtggcaagccttcaggaatgatgccacagaggtcatcccagggcttggagagtaccccgagcctcctcctgagaacaaccagaccatgaaccgggcggagaatggaggcagacctccccaccatccctatgacgccaaaggtacgggatgaagaagcacattagtgggggggggggtcctgggaggtgactggggtggttttagcatcttcttcagaggtttgtgtgggtggctagcctctgctacatcagggcagggacacatttgcctggaagaatactagcacagcattagaacctggagggcagcattggggggctggtagagagcacccaaggcagggtggaggctgaggtcagccgaagctggcattaacacgggcatgggcttgtatgatggtccagagaatctcctcctaaggatgaggacacaggtcagatctagctgctgaccagtggggaagtgatatggtgaggctggatgccagatgccatccatggctgtactatatcccacatgaccaccacatgaggtaaagaaggccccagcttgaagatggagaaaccgagaggctcctgagataaagtcacctgggagtaagaagagctgagactggaagctggtttgatccagatgcaaggcaaccctagattgggtttgggtgggaacctgaagccaggaggaatccctttagttcccccttgcccagggtctgctcaatgagcccagagggttagcattaaaagaacagggtttgtaggtggcatgtgacatgaggggcagctgagtgaaatgtcccctgtatgagcacaggtggcaccacttgccctgagcttgcaccctgaccccagctttgcctcattcctgaggacagcagaaactgtggaggcagagccagcacagagagatgcctggggtgggggtgggggtatcacgcacggaactagcagcaatgaatggggtggggtggcagctggagggacactccagagaaatgaccttgctggtcaccatttgtgtgggaggagagctcattttccagcttgccaccacatgctgtccctcctgtctcctagccagtaagggatgtggaggaaagggccaccccaaaggagcatgcaatgcagtcacgtttttgcagaggaagtgcttgacctaagggcactattcttggaaagccccaaaactagtccttccctgggcaaacaggcctcccccacataccacctctgcaggggtgagtaaattaagccagccacagaagggtggcaaggcctacacctcccccctgttgtgccccccccccccccgtgaaggtgcatcctggcctctgcccctctggctttggtactgggattttttttttccttttatgtcatattgatcctgacaccatggaacttttggaggtagacaggacccacacatggattagttaaaagcctcccatccatctaagctcatggtaggagatagagcatgtccaagagaggagggcaggcatcagacctagaagatatggctgggcatccaacccaatctccttccccggagaacagactctaagtcagatccagccacccttgagtaaccagctcaaggtacacagaacaagagagtctggtatacagcaggtgctaaacaaatgcttgtggtagcaaaagctataggttttgggtcagaactccgacccaagtcgcgagtgaagagcgaaaggccctctactcgccaccgccccgcccccacctggggtcctataacagatcactttcacccttgcgggagccagagagccctggcatcctaggtagccccccccgccccccccccgcaagcagcccagccctgcctttggggcaagttcttttctcagcctggacctgtgataatgagggggttggacgcgccgcctttggtcgctttcaagtctaatgaattcttatccctaccacctgcccttctaccccgctcctccacagcagctgtcctgatttattaccttcaattaacctccactcctttctccatctcctgggataccgcccctgtcccagtggctggtaaaggagcttaggaaggaccagagccaggtgtggctagaggctaccaggcagggctggggatgaggagctaaactggaagagtgtttggttagtaggcacaaagccttgggtgggatccctagtaccggagaagtggagatgggcgctgagaagttcaagaccatccatccttaactacacagccagtttgaggccagcctgggctacataaaaacccaatctcaaaagctgccaattctgattctgtgccacgtagtgcccgatgtaatagtggatgaagtcgttgaatcctggggcaacctattttacagatgtggggaaaagcaactttaagtaccctgcccacagatcacaaagaaagtaagtgacagagctccagtgtttcatccctgggttccaaggacagggagagagaagccagggtgggatctcactgctccccggtgcctccttcctataatccatacagattcgaaagcgcagggcaggtttggaaaaagagagaagggtggaaggagcagaccagtctggcctaggctgcagcccctcacgcatccctctctccgcagatgtgtccgagtacagctgccgcgagctgcactacacccgcttcctgacagacggcccatgccgcagcgccaagccggtcaccgagttggtgtgctccggccagtgcggccccgcgcggctgctgcccaacgccatcgggcgcgtgaagtggtggcgcccgaacggaccggatttccgctgcatcccggatcgctaccgcgcgcagcgggtgcagctgctgtgccccgggggcgcggcgccgcgctcgcgcaaggtgcgtctggtggcctcgtgcaagtgcaagcgcctcacccgcttccacaaccagtcggagctcaaggacttcgggccggagaccgcgcggccgcagaagggtcgcaagccgcggcccggcgcccggggagccaaagccaaccaggcggagctggagaacgcctactag

SEQ ID NO: 7 - DNA, 636 bp, MOUSE
atgcagccctcactagccccgtgcctcatctgcctacttgtgcacgctgccttctgtgctgtggagggccaggggtggcaagccttcaggaatgatgccacagaggtcatcccagggcttggagagtaccccgagcctcctcctgagaacaaccagaccatgaaccgggcggagaatggaggcagacctccccaccatccctatgacgccaaaggtgtgtccgagtacagctgccgcgagctgcactacacccgcttcctgacagacggcccatgccgcagcgccaagccggtcaccgagttggtgtgctccggccagtgcggccccgcgcggctgctgcccaacgccatcgggcgcgtgaagtggtggcgcccgaacggaccggatttccgctgcatcccggatcgctaccgcgcgcagcgggtgcagctgctgtgccccgggggcgcggcgccgcgctcgcgcaaggtgcgtctggtggcctcgtgcaagtgcaagcgcctcacccgcttccacaaccagtcggagctcaaggacttcgggccggagaccgcgcggccgcagaagggtcgcaagccgcggcccggcgcccggggagccaaagccaaccaggcggagctggagaacgcctactag

SEQ ID NO: 8 - DNA, 3180 bp, RAT
atgcttcctcctgccattcatctctctctcattcccctgctctgcatcctgatgaaaaactgtttggcttttaaaaatgatgccacagaaatcctttattcacatgtggttaaacctgtttcagcacaccccagcagcaacagcaccttgaatcaagccaggaatggaggcaggcacttcagtagcacgggactggatcgaaatagtaagtgtgttttatttgtacagattgttttttcttttggggagtatcagctccccactcttgtagaacacctttactgtaaactaaagtgatccatctataattttgcaaagcaatctgggagcaatctggcgcacgtgtaggctggtgttctatcctgggtagtgattttagagttaatataattgaaccagtggcttgataatgcaggcacagacatggttcatccaatgcccactggggagaaaaatgtatctgggtattgagctgatgcttttaaaaaactccgcagaaggagagtgctttgaagagttgctctgtacagtttgagctcatgtcatgttaacacttggtaatttcagaccatacacaaatttggtgaagtgtctaaaggtaactaaccagaactatgaatagggaatcacaaaggatgaaaggaagcttcaggaaatatggaattgctcacacagatgtctgaaatatgtctactctggagaggtaataaagacttgatgttcactgttaaacaggtctatactacaaaacgttggggcgccctggttttctaaattgctttttattcaacaggtcaaatcaaggtaattgtatgtttttgcgaaagactgaaaggcgatttttaaatactacatggcagtgttcagcatagtgcatatctctttacccttttcagtttgcttaattgacatacatgccaagtgactactagttaggcgggttcaaatttcttcctctaacttttgcattattttcttcctttaaaagatttcctgttagtaaccaacgtgaagaaagacagagaaactgtacaggaaaccttacacaaatccacaaatctctggcccctctaccttaaactccatccaaccacgaaaaaaaagagttttgacctttgaaaagtcataccaagtatgactggtaatatctcaccaagaaaaccaaagtgttttacttgcaggtagatgatttcagagcatagaaagcgtctggctagtattgggttactgaacagtgtggtgggtattcattgtcagtgagagaaacgtcaccacaaaaaatgcccaatcttacacatgcagggacaaaaaaagccaggagagtcaaaaatcattgctggctgtttccaggtacattcctaaggcagctgcaggaaggtgatcgggaaccaaatacaggcaagcctagcacactgtccagccaaaccgttaaccctttcatttcactctctagctttagcctcgtgtatacagacatatgcatgcatatgctacacacttcccttaggctctgagccttaaagtagacgtccagggtacagaattggagagaaacttctaacttgctgtctgctttagggttgttctcaggagtcagaagaacaatttcagcaggttttattagttttggcttggacacttcatctgcctctgttaagttttcccccctctttcatggttaataagccttgatttcttttcaagcttgtcataaataattctcatttagataacaaaggatttagatatcaaaataacaagaaagaaagcttgaagtattttaagattaattttgttttaattacacgaggcacgtgaccagaaacagccaattagagaacacacttatcaaatccaaataactaaaacaaaaagttttccatgcctgatattcaggaaatgaacaccgtggttccttgtgcagttgtaaatcagacatgttaggtatttttctgctataaaattcatggaaatgtagccaagttgttatggcaaccatacgttcctaatttaggggcttttgtattctttaaatattgaattgtagtggcattttgcatttcaaacattttgctgcttatatttttaaaacacagcttgtgaatttatgtttagaatatagttattaagtttgatatgcaaaatgtcattggttgtacccgtatgcatgtgtgaccatgcagctgaattctataattgaaacaaaatattacagcatgcctatgcactgtacacaatatttaaatgctttccacattttctcaagagatttttgaaaaacttaattcaaagcacttgcagacattaaccaatatgacccatgagcatgagtacattaaagtgtactctttgaagagtgaatatttacaggagtggaacacttgttgggaatgagactaagagaatgtgacttttcaatacttttaataaacaatcagttattgaaacacatggacaagaaacgagtctctctctcccttgctgtctccccccccctctctctcccctcccactccaaagttacagcctttaaagttacagcctttatgtaggctggccattataataaaagtgtcttccaaccctcccacagacttgcattgtgaaaatacagtacatcgcagtttgctgtaatttggatattatattatatacatattctataaagagagagtccctgcaaattacttaaaacaagaacaaaacccaaacaccttcagttacattctgtctctgatgcagttctgtcctgtttcttgcaggtcgagttcaagtgggctgcagggaactgcggtccaccaaatacatctcggatggccagtgcaccagcatcagccctctgaaggagctggtgtgcgcgggtgagtgcttgcccttgccagtgcttcccaactggatcggaggaggctacggaacaaagtactggagccggaggagctcccaggagtggcggtgtgtcaacgacaagacgcgcacccagagaatccagctgcagtgtcaggacggcagcacacgcacctacaaaatcaccgtggtcacagcgtgcaagtgcaagaggtacacccggcagcacaacgagtccagccacaactttgaaagcgtgtctcccgccaagcccgcccagcaccacagagagcggaagagagccagcaaatccagcaagcacagtctgagctagag

SEQ ID NO: 9 - DNA, 675 bp, MOUSE
  misc_feature (4)..(4): n is a, c, g, or t
  misc_feature (8)..(9): n is a, c, g, or t
  misc_feature (12)..(12): n is a, c, g, or t
  misc_feature (19)..(19): n is a, c, g, or t
  misc_feature (42)..(42): n is a, c, g, or t
taancatnnctngttctgntttgcaggatccactagtccagntgtggtggaattgcccttatgcagccctcactagccccgtgcctcatctgcctacttgtgcacgctgccttctgtgctgtggagggccaggggtggcaagccttcaggaatgatgccacagaggtcatcccagggcttggagagtaccccgagcctactcctgagaacaaccagaccatgaaccgggcggagaatggtggcagacctccccaccatccctatgacgccaaagatgtgtccgagtacagctgccgcgagctgcactacacccgcttcctgacagacggcccatgccgcagcgccaagccggtcaccgagttggtgtgctccggccagtgcggccccgcgcggctgctgcccaacgccatcgggcgcgtgaagtggtggcgcccgaacggaccggatttccgctgcatcccggatcgctaccgcgcgcagcgggtgcagctgctgtgccccgggggcgcggcgccacgctcgcgcaaggtgcgtctggtggcctcgtgcaagtgcaagcgccccacccgcttccacaaccagtcggagctcaaggacttcgggccggagaccgcgcggccgcagaagggtcgcaagccgcggcccggcgcccggggagccaaagccaaccaggcg

SEQ ID NO: 10 - DNA, 642 bp, HOMO SAPIENS
atgcagctcccactggccctgtgtctcgtctgcctgctggtacacacagccttccgtgtagtggagggccaggggtggcaggcgttcaagaatgatgccacggaaatcatccccgagctcggagagtaccccgagcctccaccggagctggagaacaacaagaccatgaaccgggcggagaacggagggcggcctccccaccacccctttgagaccaaagacgtgtccgagtacagctgccgcgagctgcacttcacccgctacgtgaccgatgggccgtgccgcagcgccaagccggtcaccgagctggtgtgctccggccagtgcggcccggcgcgcctgctgcccaacgccatcggccgcggcaagtggtggcgacctagtgggcccgacttccgctgcatccccgaccgctaccgcgcgcagcgcgtgcagctgctgtgtcccggtggtgaggcgccgcgcgcgcgcaaggtgcgcctggtggcctcgtgcaagtgcaagcgcctcacccgcttccacaaccagtcggagctcaaggacttcgggaccgaggccgctcggccgcagaagggccggaagccgcggccccgcgcccggagcgccaaagccaaccaggccgagctggagaacgcctactag

SEQ ID NO: 11 - DNA, 3400 bp, HOMO SAPIENS
atgcagctcccactggccctgtgtctcgtctgcctgctggtacacacagccttccgtgtagtggagggccaggggtggcaggcgttcaagaatgatgccacggaaatcatccccgagctcggagagtaccccgagcctccaccggagctggagaacaacaagaccatgaaccgggcggagaacggagggcggcctccccaccacccctttgagaccaaaggtatggggtggaggagagaattcttagtaaaagatcctggggaggttttagaaacttctctttgggaggcttggaagactggggtagacccagtgaagattgctggcctctgccagcactggtcgaggaacagtcttgcctggaggtgggggaagaatggctcgctggtgcagccttcaaattcaggtgcagaggcatgaggcaacagacgctggtgagagcccagggcagggaggacgctggggtggtgagggtatggcatcagggcatcagaacaggctcaggggctcagaaaagaaaaggtttcaaagaatctcctcctgggaatataggagccacgtccagctgctggtaccactgggaagggaacaaggtaagggagcctcccatccacagaacagcacctgtggggcaccggacactctatgctggtggtggctgtccccaccacacagacccacatcatggaatccccaggaggtgaacccccagctcgaaggggaagaaacaggttccaggcactcagtaacttggtagtgagaagagctgaggtgtgaacctggtttgatccaactgcaagatagccctggtgtgtgggggggtgtgggggacagatctccacaaagcagtggggaggaaggccagagaggcacccctgcagtgtgcattgcccatggcctgcccagggagctggcacttgaaggaatgggagttttcggcacagttttagcccctgacatgggtgcagctgagtccaggccctggaggggagagcagcatcctctgtgcaggagtagggacatctgtcctcagcagccaccccagtcccaaccttgcctcattccaggggagggagaaggaagaggaaccctgggttcctggtcaggcctgcacagagaagcccaggtgacagtgtgcatctggctctataattggcaggaatcctgaggccatgggggcgtctgaaatgacacttcagactaagagcttccctgtcctctggccattatccaggtggcagagaagtccactgcccaggctcctggaccccagccctccccgcctcacaacctgttgggactatggggtgctaaaaagggcaactgcatgggaggccagccaggaccctccgtcttcaaaatggaggacaagggcgcctccccccacagctccccttctaggcaaggtcagctgggctccagcgactgcctgaagggctgtaaggaacccaaacacaaaatgtccaccttgctggactcccacgagaggccacagcccctgaggaagccacatgctcaaaacaaagtcatgatctgcagaggaagtgcctggcctaggggcgctattctcgaaaagccgcaaaatgcccccttccctgggcaaatgcccccctgaccacacacacattccagccctgcagaggtgaggatgcaaaccagcccacagaccagaaagcagccccagacgatggcagtggccacatctcccctgctgtgcttgctcttcagagtgggggtggggggtggccttctctgtcccctctctggtttggtcttaagactatttttcattctttcttgtcacattggaactatccccatgaaacctttgggggtggactggtactcacacgacgaccagctatttaaaaagctcccacccatctaagtccaccataggagacatggtcaaggtgtgtgcaggggatcaggccaggcctcggagcccaatctctgcctgcccagggagtatcaccatgaggcgcccattcagataacacagaacaagaaatgtgcccagcagagagccaggtcaatgtttgtggcagctgaacctgtaggttttgggtcagagctcagggcccctatggtaggaaagtaacgacagtaaaaagcagccctcagctccatcccccagcccagcctcccatggatgctcgaacgcagagcctccactcttgccggagccaaaaggtgctgggaccccagggaagtggagtccggagatgcagcccagccttttgggcaagttcttttctctggctgggcctcagtattctcattgataatgagggggttggacacactgcctttgattcctttcaagtctaatgaattcctgtcctgatcacctccccttcagtccctcgcctccacagcagctgccctgatttattaccttcaattaacctctactcctttctccatcccctgtccacccctcccaagtggctggaaaaggaatttgggagaagccagagccaggcagaaggtgtgctgagtacttaccctgcccaggccagggaccctgcggcacaagtgtggcttaaatcataagaagaccccagaagagaaatgataataataatacataacagccgacgctttcagctatatgtgccaaatggtattttctgcattgcgtgtgtaatggattaactcgcaatgcttggggcggcccattttgcagacaggaagaagagagaggttaaggaacttgcccaagatgacacctgcagtgagcgatggagccctggtgtttgaaccccagcagtcatttggctccgaggggacagggtgcgcaggagagctttccaccagctctagagcatctgggaccttcctgcaatagatgttcaggggcaaaagcctctggagacaggcttggcaaaagcagggctggggtggagagagacgggccggtccagggcaggggtggccaggcgggcggccaccctcacgcgcgcctctctccacagacgtgtccgagtacagctgccgcgagctgcacttcacccgctacgtgaccgatgggccgtgccgcagcgccaagccggtcaccgagctggtgtgctccggccagtgcggcccggcgcgcctgctgcccaacgccatcggccgcggcaagtggtggcgacctagtgggcccgacttccgctgcatccccgaccgctaccgcgcgcagcgcgtgcagctgctgtgtcccggtggtgaggcgccgcgcgcgcgcaaggtgcgcctggtggcctcgtgcaagtgcaagcgcctcacccgcttccacaaccagtcggagctcaaggacttcgggaccgaggccgctcggccgcagaagggccggaagccgcggccccgcgcccggagcgccaaagccaaccaggccgagctggagaacgcctactag

SEQ ID NO: 12 - DNA, 1718 bp, RAT
acgcggggacagtcaatagcgcagaagcagggggaaagaattcaccgcctcagccgagtaaatcctccactcatcatgcttcctcctgccattcatctctctctcattcccctgctctgcatcctgatgaaaaactgtttggcttttaaaaatgatgccacagaaatcctttattcacatgtggttaaacctgtttcagcacaccccagcagcaacagcaccttgaatcaagccaggaatggaggcaggcacttcagtagcacgggactggatcgaaatagtcgagttcaagtgggctgcagggaactgcggtccaccaaatacatctcggatggccagtgcaccagcatcagccctctgaaggagctggtgtgcgcgggtgagtgcttgcccttgccagtgcttcccaactggatcggaggaggctacggaacaaagtactggagccggaggagctcccaggagtggcggtgtgtcaacgacaagacgcgcacccagagaatccagctgcagtgtcaggacggcagcacacgcacctacaaaatcaccgtggtcacagcgtgcaagtgcaagaggtacacccggcagcacaacgagtccagccacaactttgaaagcgtgtctcccgccaagctcgcccagcaccacagagagcggaagagagccagcaaatccagcaagcacagtctgagctagagctggactgactagaaagcatctgctccccagatttgattgcgtggaagactcgctcgagcctgccattgctcttttctcacttgaaagtatatgctttctgctttgatcaggcccagcaggctgtccttctctgggaccttctctgggactagcttttcctttgcaagtttctcaagatgtaatgagtagtttgcagtgaaagccaggcatcccatagtttcaccccctcccccagtcatttctttcaaaagcacctgatgctgcatcctgttacagtttaaaccgcgctccattccctagcccaccctttacccttcccaaactaaatccctccgaaccggagaagttcaatcaaaaaaaaaaatgtatcttcacagaacatttcacaaaggggcttttccagtagtttttatgggaatagtttgacagccaggggttagcttcctttgaaagagaggcaaaccttgtgacatttcacttcaaaaataagcccggtggcattttccagtctcagtgtgaaattatccccctcgtgttgacctctcttggagtggaatgccagcaatgcaaggcagcagctaataggtaaagccggttatttatttgtcgatgttgttatttaatgagctcgcgcatgtgattttttttccaaatgttaatttttttttatattttgaagctttttcatgtacctaaatatttcccaatacgatttgtggttggtctagaaatatgaaaatacatgttgtagatatgtaaaaataaatattttagactccttatatattacacggttcctcatacactttgtcattagcgtggttccctgtaaagctgaagttatgtaatactttattatttagtccatgaaatcagaaggcagcttgaccttcggtgccatcggtttcttttaataaacataaatatccgcaaaaaaaaaaaaaaaaaaaaaaaaaaaaaaaaaaaaaaaaaaaaaaaaaaaaaaaaaaattaaaaaaaaaaaaaaaaaaaaaaaaaaa

SEQ ID NO: 13 - DNA, 574 bp, CHICK
  misc_feature (570)..(570): n is a, c, g, or t
  misc_feature (574)..(574): n is a, c, g, or t
agctggctagttaagcttggtaccgagctcggatccactagtccagtgtggtggaattgcccttggccaggggtggcaggcgttcgatgaggtgggcgatgcgcgcggcccggtagccgtagtcccagtcgcgggagaggaagtactcgtagtcgtcgccgacgatcgcgttgttcgcggtgacgatgtatccggagctcgggttgtatgacaccggaagttcctcgaacgggatgaagccggtccagtcgtagctgctgtcccatcccggctgcggcatccatccgtcgccggcgccgcggatgggcagccgtccgggcgtctggtatccgatgttgccctcggtgtcggcgtagacgaggttctgcgccggaacatcgaagagggatgccgcggcgcggaagtcgtcgaagtcctgggcggtcgagagggcgaagatcgccgtcgcggcggtgccggggtcgagcgcggtccagcgcaggctcagcgcgtactccgcgtcatccgtcgtctcagcgggggcctccggcgaagccgggggcgcgtcaccggccgccaatcccggcagcngggn

SEQ ID NO: 14 - DNA, 674 bp, RAT
gaggaccgagtgcccttcctccttctggcaccatgcagctctcactagccccttgccttgcctgcctgcttgtacatgcagccttcgttgctgtggagagccaggggtggcaagccttcaagaatgatgccacagaaatcatcccgggactcagagagtacccagagcctcctcaggaactagagaacaaccagaccatgaaccgggccgagaacggaggcagacccccccaccatccttatgacaccaaagacgtgtccgagtacagctgccgcgagctgcactacacccgcttcgtgaccgacggcccgtgccgcagtgccaagccggtcaccgagttggtgtgctcgggccagtgcggccccgcgcggctgctgcccaacgccatcgggcgcgtgaagtggtggcgcccgaacggacccgacttccgctgcatcccggatcgctaccgcgcgcagcgggtgcagctgctgtgccccggcggcgcggcgccgcgctcgcgcaaggtgcgtctggtggcctcgtgcaagtgcaagcgcctcacccgcttccacaaccagtcggagctcaaggacttcggacctgagaccgcgcggccgcagaagggtcgcaagccgcggccccgcgcccggggagccaaagccaaccaggcggagctggagaacgcctactag

SEQ ID NO: 15 - DNA, 1047 bp, MOUSE
atgctcgcctccgtcgcaggtcccatcagcctcgccttggtgctcctcgccctctgcacccggcctgctacgggccaggactgcagcgcgcaatgtcagtgcgcagccgaagcagcgccgcactgccccgccggcgtgagcctggtgctggacggctgcggctgctgccgcgtctgcgccaagcagctgggagaactgtgtacggagcgtgacccctgcgacccacacaagggcctcttctgcgatttcggctcccccgccaaccgcaagattggagtgtgcactgccaaagatggtgcaccctgtgtcttcggtgggtcggtgtaccgcagcggtgagtccttccaaagcagctgcaaataccaatgcacttgcctggatggggccgtgggctgcgtgcccctatgcagcatggacgtgcgcctgcccagccctgactgccccttcccgagaagggtcaagctgcctgggaaatgctgcaaggagtgggtgtgtgacgagcccaaggaccgcacagcagttggccctgccctagctgcctaccgactggaagacacatttggcccagacccaactatgatgcgagccaactgcctggtccagaccacagagtggagcgcctgttctaagacctgtggaatgggcatctccacccgagttaccaatgacaataccttctgcagactggagaagcagagccgcctctgcatggtcaggccctgcgaagctgacctggaggaaaacattaagaagggcaaaaagtgcatccggacacctaaaatcgccaagcctgtcaagtttgagctttctggctgcaccagtgtgaagacatacagggctaagttctgcggggtgtgcacagacggccgctgctgcacaccgcacagaaccaccactctgccagtggagttcaaatgccccgatggcgagatcatgaaaaagaatatgatgttcatcaagacctgtgcctgccattacaactgtcctggggacaatgacatctttgagtccctgtactacaggaagatgtacggagacatggcgtaa

SEQ ID NO: 16 - DNA, 1050 bp, HOMO SAPIENS
atgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatga

SEQ ID NO: 17 - DNA, 1050 bp, BOVINE
atgtcagccaccggcctgggcccggtccgctgcgccttcgtgctcctgctcgccctctgcagccggcccgcctccagccaggactgctgcagcgccccgtgccagtgccctgccggcccggcgccgcgctgccccgccggcgtcagcttggtgctggacggctgcggctgctgcgtgtgcgccaagcagctgagcgagttgtgtaccgagcgcgacccctgcgatccgcacaagggcctcttctgcgacttcggctccccaaccaaccgcaagatcggcgtgtgcaccgctaaagatggtgccccctacattttcggaggaactgtgtaccagagcggagagtctttccagagcagctgcaaataccagtgcacgtgtctggacgggtcggtgggctgcgtgcccctatgcagcgtggacgtccgcctgcccagccccgactgccccttcccacggagggtcaaactgcccgggaaatgctgcgaggaatgggtgtcccgtgatgagaaggagcacaccgtggtcggccctgcgctggcagcttaccggctggaagacacgtttggcccagacccaaccatgatccgagccaactgccaggtccagaccacagagtggagtgcctattccaagacctgcggaatgggcatctccacccgggttaccaatgacaacgcattctgcaggctggagaagcagagccgcctctgcatggtcaggccttgcgaagctgacctggaggagaacattaagaaaggcaaaaagtgcatccggactcccaaaatctccaagcctatcaagtttcagctttctggctgcaccagcatgaagacataccgagctaaattcttcggagtgtgcacagacgggcggtgctgcaccccccacagaaccaccacccttcccgtggagttcaagtgtcctgatggggaggtcatgaagaagagcatgatgttcatcaagacctgtgcctgccattacaactgccccggagacaatgacatcttcgagtcactgtactacaggaagatgtatggagacatggcctaa

SEQ ID NO: 18 - DNA, 1065 bp, MOUSE
atgagcctcttcctgcgaaagcgatgcctctgcctaggcttcctgctcttccatctcttaagtcaagtctctgcatctctgcgctgcccttctcggtgcccgcccaagtgccccagtatatcaccgacctgcgcccccggggtgcgctcggtgctggacggctgctcctgctgtccggtgtgcgcccgccagcgcggggagagttgttctgagatgagaccctgtgaccagagcagtggtctctactgtgaccgcagcgcagaccccaacaaccagactggcatttgcatggttccagagggagacaactgtgtgttcgatggggtcatttaccgcaacggagagaagtttgagccgaactgtcagtacttctgcacctgcagagatgggcagattggctgtctgccccgctgccagctagacgtgctactgccgggtcctgactgcccagctccgagaaaagtcgcagtgccaggggagtgctgcgaaaagtggacctgtggctcagacgagcaggggacacaggggacgctgggaggcttggcccttccagcctatagaccggaagccaccgtaggagttgaagtctctgactccagcattaactgcattgagcagacgacggagtggagcgcatgttccaagagctgtggaatgggcgtgtccacccgggtcaccaacaggaatcgccagtgtgagatggtaaaacagactcgtctctgcatcgttcggccttgtgaacaagagcccgaggaagtaacagacaagaaaggtaaaaagtgtctccgcaccaagaagtccctgaaagccatccacctacagttcgagaattgcactagcttgtacacctataagccccggttctgtggggtctgcagtgatggccgctgctgtaccccccacaacaccaaaaccatccaggtggagtttcagtgtctcccgggggaaatcatcaagaaaccagtcatggtcattggaacctgtacctgctactccaactgccctcagaacaatgaggccttcctccaagatctggagctgaagacaagcagaggagaaatttaa

SEQ ID NO: 19 - DNA, 1074 bp, HOMO SAPIENS
atgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaa

SEQ ID NO: 20 - DNA, 1140 bp, MOUSE
atgagctccagcaccttcaggacgctcgctgtcgccgtcacccttctccacttgaccagactggcgctctccacctgccccgccgcctgccactgccctctggaggcacccaagtgcgccccgggagtcgggttggtccgggacggctgcggctgctgtaaggtctgcgctaaacaactcaacgaggactgcagcaaaactcagccctgcgaccacaccaaggggttggaatgcaatttcggcgccagctccaccgctctgaaagggatctgcagagctcagtcagaaggcagaccctgtgaatataactccagaatctaccaaaacggggaaagcttccagcccaactgtaaacaccagtgcacatgtattgatggcgccgtgggctgcattcctctgtgtccccaagaactgtctctccccaatctgggctgtcccaacccccggctggtgaaagtcagcgggcagtgctgtgaagagtgggtttgtgatgaagacagcattaaggactccctggacgaccaggatgacctcctcggactcgatgcctcggaggtggagttaacgagaaacaatgagttaatcgcaattggaaaaggcagctcactgaagaggcttcctgtctttggcaccgaaccgcgagttcttttcaaccctctgcacgcccatggccagaaatgcatcgttcagaccacgtcttggtcccagtgctccaagagctgcggaactggcatctccacacgagttaccaatgacaacccagagtgccgcctggtgaaagagacccggatctgtgaagtgcgtccttgtggacaaccagtgtacagcagcctaaaaaagggcaagaaatgcagcaagaccaagaaatccccagaaccagtcagatttacttatgcaggatgctccagtgtcaagaaataccggcccaaatactgcggctcctgcgtagatggccggtgctgcacacctctgcagaccagaactgtgaagatgcggttccgatgcgaagatggagagatgttttccaagaatgtcatgatgatccagtcctgcaaatgtaactacaactgcccgcatcccaacgaggcatcgttccgactgtacagcctattcaatgacatccacaagttcagggactaa

SEQ ID NO: 21 - DNA, 1146 bp, HOMO SAPIENS
atgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaa

SEQ ID NO: 22 - DNA, 1140 bp, RAT
atgagctccagcaccatcaagacgctcgctgtcgccgtcacccttctccacttgaccaggctggcactctccacctgccctgcctcctgccactgccctctggaggcgcccaagtgcgccccgggagtcggcttggtccgggacggctgcggctgctgtaaggtctgcgcgaagcaactcaacgaggactgcagcaaaacgcaaccctgcgaccacaccaaggggctggaatgcaatttcggcgccaattccaccgctctgaaagggatctgcagagctcagtcagaaggcagaccttgtgaatataactccaggatctaccagaacggggagagcttccaacccaactgtaaacatcagtgcacatgtattgacggtgctgtgggctgcattcctctgtgtccccaagaactgtctctccccaatctgggctgtcccaacccccggctggtgaaagtcagcgggcagtgctgtgaggaatgggtctgtgatgaagacagcattaaggactccctggacgaccaggacgacctccttggattcgatgcctcggaggtggagttaacaagaaacaatgagttaatcgcaactggcaaaggcagctcactgaagaggcttcctgtctttggcacggaacctcgagtcctttacaaccccctgcatgcccatggccagaaatgcatcgttcagactacgtcctggtcccagtgctccaagagctgcggaactggcatctccacacgagttaccaatgacaacccggagtgccgcctggtgaaagagacccggatctgtgaagtgcgtccttgtggacaaccagtgtacagcagcctaaaaaagggcaagaaatgcagcaagaccaagaaatccccagaaccagtccgatttacttatgcaggatgctccagtgtgaagaaataccggcccaaatactgcggctcctgcgtggacggccggtgctgcacacctctgcagaccaggaccgtgaagatgcggttccggtgcgaagatggcgagatgttctccaagaacgtcatgatgattcagtcctgcaagtgtaactacaactgcccgcatcccaacgaggcgtcgtttcgcctctacagtctgttcaacgatatccacaagttcagggactaa

SEQ ID NO: 23 - DNA, 1128 bp, XENOPUS
atgagcttcctagcacttaaccccgtccttgctattgcccttctttctggattcattgacttggctgtgtcatcgtgcccagcagtgtgccaatgtccggttgaagtacccaaatgtgccccaggagttggactggttctggatggttgtggatgttgcaaaatctgtgctaagcagctcaatgaagattgcagcaaaactcatccttgtgatcacaccaagggacttgaatgcaattttggagccagttccagagccattaagggaatatgtagagcaaaatcagaagggagaccttgtgagtacaattccaaaatctaccagaatggagaaagttttcagccaaactgcaagcatcagtgcacatgcatagatggagctgttggttgccttccattgtgtcctcaagaactatccctgcctaacttgggctgcccaaatccaaggctggtgaaggttccagggcagtgctgtgaggagtgggtctgcgatgaagccaaagatccagtcgatgagatggatgacttctttaacaaagaatttggaatggatactaatgaaggagaacttacaaggaaaaatgaatttgttgcggtcatcaaaggaggactaaaaatgctgcctgtttttggctctgacccgcaaagtcatgttgtggagaactcgaagtgcattgttcaaaccacatcgtggtctcagtgctcaaagacctgtggaactggtatctctacgagagtcacaaatgataacagcaactgcagactcgtgagggagaccagaatctgtgaagtccgaccttgtggccagccaagctatacaagtttaaagaagggaaagaaatgcaccaagacaaaaaaatctcaagctccagtaagatacacatacgccggatgttccagtgtaaagaaatatcgtccaaaatattgtggatcatgtgtggatgggaggtgctgcactccacagcagacaaggactgtcaaaatccgattccgttgtgaggatggggagacctttactaaaaatgtcatgatgatccagtcatgtagatgcaactacaactgcccacatacaaatgaagcctatccttactacagattattcaatgatatccacaaattcagagactaa

SEQ ID NO: 24 - DNA, 555 bp, MOUSE
atgaatcgcaccgcatacactgtgggagcgttgcttctcctcctggggaccctactgccaacagctgaggggaaaaagaaaggttcccaaggagccattccgcctcctgacaaggctcagcacaatgactctgagcagacccagtccccaccacaacctggctccaggacccgggggcggggccaggggcggggcaccgccatgcctggagaggaggtgcttgagtccagccaagaggccctgcacgtgacagagcgcaagtatctgaagcgagattggtgcaaaactcagcccctgaagcagaccatccacgaggagggctgcaacagccgcactatcatcaaccgcttctgttatggccagtgcaactccttctacatccccaggcacatccgaaaggaggaagggtcctttcagtcttgctccttctgcaagcccaagaagttcaccaccatgatggtcacactcaactgtcctgagctacagccacccaccaagaagaaaagggtcacacgcgtgaagcagtgccgttgcatatccatcgacttggattaa

SEQ ID NO: 25 - DNA, 555 bp, MOUSE; identical to SEQ ID NO: 24

SEQ ID NO: 26 - DNA, 555 bp, HOMO SAPIENS
atgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaa

SEQ ID NO: 27 - DNA, 804 bp, HOMO SAPIENS
atgcatctcctcttatttcagctgctggtactcctgcctctaggaaagaccacacggcaccaggatggccgccagaatcagagttctctttcccccgtactcctgccaaggaatcaaagagagcttcccacaggcaaccatgaggaagctgaggagaagccagatctgtttgtcgcagtgccacaccttgtagccaccagccctgcaggggaaggccagaggcagagagagaagatgctgtccagatttggcaggttctggaagaagcctgagagagaaatgcatccatccagggactcagatagtgagcccttcccacctgggacccagtccctcatccagccgatagatggaatgaaaatggagaaatctcctcttcgggaagaagccaagaaattctggcaccacttcatgttcagaaaaactccggcttctcagggggtcatcttgcccatcaaaagccatgaagtacattgggagacctgcaggacagtgcccttcagccagactataacccacgaaggctgtgaaaaagtagttgttcagaacaacctttgctttgggaaatgcgggtctgttcattttcctggagccgcgcagcactcccatacctcctgctctcactgtttgcctgccaagttcaccacgatgcacttgccactgaactgcactgaactttcctccgtgatcaaggtggtgatgctggtggaggagtgccagtgcaaggtgaagacggagcatgaagatggacacatcctacatgctggctcccaggattcctttatcccaggagtttcagcttga

SEQ ID NO: 28 - DNA, 804 bp, HOMO SAPIENS; identical to SEQ ID NO: 27

SEQ ID NO: 29 - DNA, 13638 bp, MOUSE
atgctgaccccgccgttgctgctgctcgtgccgctgctttcagctctggtctccggggccactatggatgcccctaaaacttgcagccctaagcagtttgcctgcagagaccaaatcacctgtatctcaaagggctggcggtgtgacggtgaaagagattgccccgacggctctgatgaagcccctgagatctgtccacagagtaaagcccagagatgcccgccaaatgagcacagttgtctggggactgagctatgtgtccccatgtctcgtctctgcaacgggatccaggactgcatggatggctcagacgagggtgctcactgccgagagctccgagccaactgttctcgaatgggttgtcaacaccattgtgtacctacacccagtgggcccacgtgctactgtaacagcagcttccagctcgaggcagatggcaagacgtgcaaagattttgacgagtgttccgtgtatggcacctgcagccagctttgcaccaacacagatggctccttcacatgtggctgtgttgaaggctacctgctgcaaccggacaaccgctcctgcaaggccaagaatgagccagtagatcggccgccagtgctactgattgccaactctcagaacatcctagctacgtacctgagtggggcccaagtgtctaccatcacacccaccagcacccgacaaaccacggccatggacttcagttatgccaatgagaccgtatgctgggtgcacgttggggacagtgctgcccagacacagctcaagtgtgcccggatgcctggcctgaagggctttgtggatgagcataccatcaacatctccctcagcctgcaccacgtggagcagatggcaatcgactggctgacgggaaacttctactttgtcgacgacattgacgacaggatctttgtctgtaaccgaaacggggacacctgtgtcactctgctggacctggaactctacaaccccaaaggcatcgccttggaccccgccatggggaaggtgttcttcactgactacgggcagatcccaaaggtggagcgctgtgacatggatggacagaaccgcaccaagctggtggatagcaagatcgtgtttccacacggcatcaccctggacctggtcagccgcctcgtctactgggcggacgcctacctagactacatcgaggtggtagactacgaagggaagggtcggcagaccatcatccaaggcatcctgatcgagcacctgtacggcctgaccgtgtttgagaactatctctacgccaccaactcggacaatgccaacacgcagcagaagacgagcgtgatccgagtgaaccggttcaacagtactgagtaccaggtcgtcacccgtgtggacaagggtggtgccctgcatatctaccaccagcgacgccagccccgagtgcggagtcacgcctgtgagaatgaccagtacgggaagccaggtggctgctccgacatctgcctcctggccaacagtcacaaggcaaggacctgcaggtgcaggtctggcttcagcctgggaagtgatgggaagtcttgtaagaaacctgaacatgagctgttcctcgtgtatggcaagggccgaccaggcatcattagaggcatggacatgggggccaaggtcccagatgagcacatgatccccatcgagaaccttatgaatccacgcgctctggacttccacgccgagaccggcttcatctactttgctgacaccaccagctacctcattggccgccagaaaattgatggcacggagagagagactatcctgaaggatggcatccacaatgtggagggcgtagccgtggactggatgggagacaatctttactggactgatgatggccccaagaagaccattagtgtggccaggctggagaaagccgctcagacccggaagactctaattgagggcaagatgacacaccccagggccattgtagtggatccactcaatgggtggatgtactggacagactgggaggaggaccccaaggacagtcggcgagggcggctcgagagggcttggatggacggctcacaccgagatatctttgtcacctccaagacagtgctttggcccaatgggctaagcctggatatcccagccggacgcctctactgggtggatgccttctatgaccgaattgagaccatactgctcaatggcacagaccggaagattgtatatgagggtcctgaactgaatcatgccttcggcctgtgtcaccatggcaactacctcttttggaccgagtaccggagcggcagcgtctaccgcttggaacggggcgtggcaggcgcaccgcccactgtgacccttctgcgcagcgagagaccgcctatctttgagatccgaatgtacgacgcgcacgagcagcaagtgggtaccaacaaatgccgggtaaataacggaggctgcagcagcctgtgcctcgccacccccgggagccgccagtgtgcctgtgccgaggaccaggtgttggacacagatggtgtcacctgcttggcgaacccatcctacgtgcccccaccccagtgccagccgggccagtttgcctgtgccaacaaccgctgcatccaggagcgctggaagtgtgacggagacaacgactgtctggacaacagcgatgaggccccagcactgtgccatcaacacacctgtccctcggaccgattcaagtgtgagaacaaccggtgtatccccaaccgctggctctgtgatggggataatgattgtggcaacagcgaggacgaatccaatgccacgtgctcagcccgcacctgtccacccaaccagttctcctgtgccagtggccgatgcattcctatctcatggacctgtgatctggatgatgactgtggggaccggtccgatgagtcagcctcatgcgcctaccccacctgcttccccctgactcaatttacctgcaacaatggcagatgtattaacatcaactggcggtgtgacaacgacaatgactgtggggacaacagcgacgaagccggctgcagtcactcctgctccagtacccagttcaagtgcaacagtggcagatgcatccccgagcactggacgtgtgatggggacaatgattgtggggactacagcgacgagacacacgccaactgtaccaaccaggctacaagacctcctggtggctgccactcggatgagttccagtgcccgctagatggcctgtgcatccccctgaggtggcgctgcgacggggacaccgactgcatggattccagcgatgagaagagctgtgagggcgtgacccatgtttgtgacccgaatgtcaagtttggctgcaaggactccgcccggtgcatcagcaaggcgtgggtgtgtgatggcgacagcgactgtgaagataactccgacgaggagaactgtgaggccctggcctgcaggccaccctcccatccctgcgccaacaacacctctgtctgcctgcctcctgacaagctgtgcgacggcaaggatgactgtggagacggctcggatgagggcgagctctgtgaccagtgttctctgaataatggtggctgtagtcacaactgctcagtggcccctggtgaaggcatcgtgtgctcttgccctctgggcatggagctgggctctgacaaccacacctgccagatccagagctactgtgccaagcacctcaaatgcagccagaagtgtgaccagaacaagttcagtgtgaagtgctcctgctacgagggctgggtcttggagcctgacggggaaacgtgccgcagtctggatcccttcaaactgttcatcatcttctccaaccgccacgagatcaggcgcattgaccttcacaagggggactacagcgtcctagtgcctggcctgcgcaacactattgccctggacttccacctcagccagagtgccctctactggaccgacgcggtagaggacaagatctaccgtgggaaactcctggacaacggagccctgaccagctttgaggtggtgattcagtatggcttggccacaccagagggcctggctgtagattggattgcaggcaacatctactgggtggagagcaacctggaccagatcgaagtggccaagctggacggaaccctccgaaccactctgctggcgggtgacattgagcacccgagggccatcgctctggaccctcgggatgggattctgttttggacagactgggatgccagcctgccacgaatcgaggctgcatccatgagtggagctggccgccgaaccatccaccgggagacaggctctgggggctgcgccaatgggctcaccgtggattacctggagaagcgcatcctctggattgatgctaggtcagatgccatctattcagcccggtatgacggctccggccacatggaggtgcttcggggacacgagttcctgtcacacccatttgccgtgacactgtacggtggggaggtgtactggaccgactggcgaacaaatacactggctaaggccaacaagtggactggccacaacgtcaccgtggtacagaggaccaacacccagcccttcgacctgcaggtgtatcacccttcccggcagcccatggctccaaacccatgtgaggccaatggcggccggggcccctgttcccatctgtgcctcatcaactacaaccggaccgtctcctgggcctgtccccacctcatgaagctgcacaaggacaacaccacctgctatgagtttaagaagttcctgctgtacgcacgtcagatggagatccggggcgtggacctggatgccccgtactacaattatatcatctccttcacggtgcctgatatcgacaatgtcacggtgctggactatgatgcccgagagcagcgagtttactggtctgatgtgcggactcaagccatcaaaagggcatttatcaacggcactggcgtggagaccgttgtctctgcagacttgcccaacgcccacgggctggctgtggactgggtctcccgaaatctgttttggacaagttacgacaccaacaagaagcagattaacgtggcccggctggacggctccttcaagaatgcggtggtgcagggcctggagcagccccacggcctggtcgtccacccgcttcgtggcaagctctactggactgatggggacaacatcagcatggccaacatggatgggagcaaccacactctgctcttcagtggccagaagggccctgtggggttggccattgacttccctgagagcaaactctactggatcagctctgggaaccacacaatcaaccgttgcaatctggatgggagcgagctggaggtcatcgacaccatgcggagccagctgggcaaggccactgccctggccatcatgggggacaagctgtggtgggcagatcaggtgtcagagaagatgggcacgtgcaacaaagccgatggctctgggtccgtggtgctgcggaacagtaccacgttggttatgcacatgaaggtgtatgacgagagcatccagctagagcatgagggcaccaacccctgcagtgtcaacaacggagactgttcccagctctgcctgccaacatcagagacgactcgctcctgtatgtgtacagccggttacagcctccggagcggacagcaggcctgtgagggtgtgggctcttttctcctgtactctgtacatgagggaattcgggggattccactagatcccaatgacaagtcggatgccctggtcccagtgtccggaacttcactggctgtcggaatcgacttccatgccgaaaatgacactatttattgggtggatatgggcctaagcaccatcagcagggccaagcgtgaccagacatggcgagaggatgtggtgaccaacggtattggccgtgtggagggcatcgccgtggactggatcgcaggcaacatatactggacggaccagggcttcgatgtcatcgaggttgcccggctcaatggctcttttcgttatgtggtcatttcccagggtctggacaagcctcgggccatcactgtccacccagagaaggggtacttgttctggaccgagtggggtcattacccacgtattgagcggtctcgccttgatggcacagagagagtggtgttggttaatgtcagcatcagctggcccaatggcatctcagtagactatcagggcggcaagctctactggtgtgatgctcggatggacaagatcgagcgcatcgacctggaaacgggcgagaaccgggaggtggtcctgtccagcaataacatggatatgttctccgtgtccgtgtttgaggacttcatctactggagtgacagaactcacgccaatggctccatcaagcgcggctgcaaagacaatgctacagactccgtgcctctgaggacaggcattggtgttcagcttaaagacatcaaggtcttcaacagggacaggcagaagggtaccaatgtgtgcgcggtagccaacggcgggtgccagcagctctgcttgtatcggggtggcggacagcgagcctgtgcctgtgcccacgggatgctggcagaagacggggcctcatgccgagagtacgctggctacctgctctactcagagcggaccatcctcaagagcatccacctgtcggatgagcgtaacctcaacgcaccggtgcagccctttgaagaccccgagcacatgaaaaatgtcatcgccctggcctttgactaccgagcaggcacctccccggggacccctaaccgcatcttcttcagtgacatccactttgggaacatccagcagatcaatgacgatggctcgggcaggaccaccatcgtggaaaatgtgggctctgtggaaggcctggcctatcaccgtggctgggacacactgtactggacaagctacaccacatccaccatcacccgccacaccgtggaccagactcgcccaggggccttcgagagggagacagtcatcaccatgtccggagacgaccacccgagagcctttgtgctggatgagtgccagaacctgatgttctggaccaattggaacgagctccatccaagcatcatgcgggcagccctatccggagccaacgtcctgaccctcattgagaaggacatccgcacgcccaatgggttggccatcgaccaccgggcggagaagctgtacttctcggatgccaccttggacaagatcgagcgctgcgagtacgacggctcccaccgctatgtgatcctaaagtcggagcccgtccacccctttgggttggcggtgtacggagagcacattttctggactgactgggtgcggcgggctgtgcagcgagccaacaagtatgtgggcagcgacatgaagctgcttcgggtggacattccccagcaacccatgggcatcatcgccgtggccaatgacaccaacagctgtgaactctccccctgccgtatcaacaatggaggctgccaggatctgtgtctgctcacccaccaaggccacgtcaactgttcctgtcgagggggccggatcctccaggaggacttcacctgccgggctgtgaactcctcttgtcgggcacaagatgagtttgagtgtgccaatggggaatgtatcagcttcagcctcacctgtgatggcgtctcccactgcaaggacaagtccgatgagaagccctcctactgcaactcacgccgctgcaagaagactttccgccagtgtaacaatggccgctgtgtatccaacatgctgtggtgcaatggggtggattactgtggggatggctctgatgagataccttgcaacaagactgcctgtggtgtgggtgagttccgctgccgggatgggtcctgcatcgggaactccagtcgctgcaaccagtttgtggattgtgaggatgcctcggatgagatgaattgcagtgccacagactgcagcagctatttccgcctgggcgtgaaaggtgtcctcttccagccgtgcgagcggacatccctgtgctacgcacctagctgggtgtgtgatggcgccaacgactgtggagactacagcgatgaacgtgactgtccaggtgtgaagcgccctaggtgcccgctcaattactttgcctgccccagcgggcgctgtatccccatgagctggacgtgtgacaaggaggatgactgtgagaacggcgaggatgagacccactgcaacaagttctgctcagaggcacagttcgagtgccagaaccaccggtgtatctccaagcagtggctgtgtgacggtagcgatgattgcggggatggctccgatgaggcagctcactgtgaaggcaagacatgtggcccctcctccttctcctgtcccggcacccacgtgtgtgtccctgagcgctggctctgtgatggcgacaaggactgtaccgatggcgcggatgagagtgtcactgctggctgcctgtacaacagcacctgtgatgaccgtgagttcatgtgccagaaccgcttgtgtattcccaagcatttcgtgtgcgaccatgaccgtgactgtgctgatggctctgatgaatcccctgagtgtgagtacccaacctgcgggcccaatgaattccgctgtgccaatgggcgttgtctgagctcccgtcagtgggaatgtgatggggagaatgactgtcacgaccacagcgatgaggctcccaagaacccacactgcaccagcccagagcacaaatgcaatgcctcatcacagttcctgtgcagcagcgggcgctgcgtggctgaggcgttgctctgcaacggccaggacgactgtggggacggttcagacgaacgcgggtgccatgtcaacgagtgtctcagccgcaagctcagtggctgcagtcaggactgcgaggacctcaagataggctttaagtgccgctgtcgcccgggcttccggctaaaggacgatggcaggacctgtgccgacctggatgagtgcagcaccaccttcccctgcagccagctctgcatcaacacccacggaagttacaagtgtctgtgtgtggagggctatgcaccccgtggcggtgacccccacagctgcaaagctgtgaccgatgaggagccatttctcatctttgccaaccggtactacctgcggaagctcaacctggacggctccaactacacactgcttaagcagggcctgaacaatgcggtcgccttggcatttgactaccgagagcagatgatctactggacgggcgtgaccacccagggcagcatgattcgcaggatgcacctcaacggcagcaacgtgcaggttctgcaccggacgggccttagtaacccagatgggctcgctgtggactgggtgggtggcaacctgtactggtgtgacaagggcagagataccattgaggtgtccaagcttaacggggcctatcggacagtgctggtcagctctggcctccgggagcccagagctctggtagtggatgtacagaatgggtacctgtactggacagactggggtgaccactcactgatcggccggattggcatggatggatctggccgcagcatcatcgtggacactaagatcacatggcccaatggcctgaccgtggactacgtcacggaacgcatctactgggctgacgcccgtgaggactacatcgagttcgccagcctggatggctccaaccgtcacgttgtgctgagccaagacatcccacacatctttgcgctgaccctatttgaagactacgtctactggacagactgggaaacgaagtccatcaaccgggcccacaagaccacgggtgccaacaaaacactcctcatcagcaccctgcaccggcccatggacttacatgtattccacgccctgcgccagccagatgtgcccaatcacccctgcaaagtcaacaatggtggctgcagcaacctgtgcctgctgtcccctgggggtggtcacaagtgcgcctgccccaccaacttctatctgggtggcgatggccgtacctgtgtgtccaactgcacagcaagccagtttgtgtgcaaaaatgacaagtgcatccccttctggtggaagtgtgacacggaggacgactgtggggatcactcagacgagcctccagactgtcccgagttcaagtgccgcccaggccagttccagtgctccaccggcatctgcaccaaccctgccttcatctgtgatggggacaatgactgccaagacaatagtgacgaggccaattgcgacattcacgtctgcttgcccagccaattcaagtgcaccaacaccaaccgctgcattcctggcatcttccgttgcaatgggcaggacaactgcggggacggcgaggatgagcgggattgccctgaggtgacctgcgcccccaaccagttccagtgctccatcaccaagcgctgcatccctcgcgtctgggtctgtgacagggataatcactgtgtggacggcagtgatgagcctgccaactgtacccaaatgacctgtggagtggatgagttccgctgcaaggattctggccgctgcatccccgcgcgctggaagtgtgacggagaagatgactgtggggatggttcagatgagcccaaggaagagtgtgatgagcgcacctgtgagccataccagttccgctgcaaaaacaaccgctgtgtcccaggccgttggcaatgtgactacgacaacgactgcggagataactcggacgaggagagctgcacacctcggccctgctctgagagtgagtttttctgtgccaatggccgctgcatcgctgggcgctggaagtgtgatggggaccatgactgtgccgacggctcagacgagaaagactgcaccccccgctgtgatatggaccagttccagtgcaagagtggccactgcatccccctgcgctggccgtgtgacgcggatgctgactgtatggacggcagtgacgaggaagcctgtggcactggggtgaggacctgcccattggatgagtttcaatgtaacaacaccttgtgcaagccgctggcctggaagtgtgatggagaggacgactgtggggacaactcagatgagaaccccgaggaatgcgcccggttcatctgccctcccaaccggcctttccgctgcaagaatgaccgagtctgcctgtggattgggcgccagtgtgatggcgtggacaactgtggagatgggactgacgaggaggactgtgagccccccacggcccagaacccccactgcaaagacaagaaggagttcctgtgccgaaaccagcgctgtctatcatcctccctgcgctgtaacatgttcgatgactgcggcgatggctccgatgaagaagattgcagcatcgaccccaagctgaccagctgtgccaccaatgccagcatgtgtggggacgaagctcgttgtgtgcgcactgagaaagctgcctactgtgcctgccgctcgggcttccatactgtgccgggccagcccggatgccaggacatcaacgagtgcctgcgctttggtacctgctctcagctctggaacaaacccaagggaggccacctctgcagctgtgcccgcaacttcatgaagacacacaacacctgcaaagctgaaggctccgagtaccaggtgctatacatcgcggatgacaacgagatccgcagcttgttcccgggccacccccactcagcctacgagcagacattccagggcgatgagagtgtccgcatagatgccatggatgtccatgtcaaggccggccgtgtctactggactaactggcacacgggcacaatctcctacaggagcctgccccctgccgcccctcctaccacttccaaccgccaccggaggcagatcgaccggggtgtcacccacctcaatatttcagggctgaagatgccgaggggtatcgctatcgactgggtggccgggaatgtgtactggaccgattccggccgagacgtgattgaggtggcgcaaatgaagggcgagaaccgcaagacgctcatctcgggcatgattgatgagccccatgccatcgtggtggaccctctgaggggcaccatgtactggtcagactgggggaaccaccccaagattgaaacagcagcgatggatggcacccttcgggagactctcgtgcaagacaacattcagtggcctacagggctggctgtggactatcacaatgaacggctctactgggcagatgccaagctttcggtcatcggcagcatccggctcaacggcactgaccccattgtggctgctgacagcaaacgaggcctaagtcaccccttcagcatcgatgtgtttgaagactacatctacggagtcacttacatcaataatcgtgtcttcaagatccacaagtttggacacagccccttgtacaacctaactgggggcctgagccatgcctctgatgtagtcctttaccatcaacacaagcagcctgaagtgaccaacccctgtgaccgcaagaaatgcgaatggctgtgtctgctgagccccagcgggcctgtctgcacctgtcccaatggaaagaggctggataatggcacctgtgtgcctgtgccctctccaacaccccctccagatgcccctaggcctggaacctgcactctgcagtgcttcaatggtggtagttgtttcctcaacgctcggaggcagcccaagtgccgttgccagccccgttacacaggcgataagtgtgagctggatcagtgctgggaatactgtcacaacggaggcacctgtgcggcttccccatctggcatgcccacgtgccgctgtcccactggcttcacgggccccaaatgcaccgcacaggtgtgtgcaggctactgctctaacaacagcacctgcaccgtcaaccagggcaaccagccccagtgccgatgtctacctggcttcctgggcgaccgttgccagtaccggcagtgctctggcttctgtgagaactttggcacctgtcagatggctgctgatggctcccgacaatgtcgctgcaccgtctactttgagggaccaaggtgtgaggtgaacaagtgtagtcgctgtctccaaggcgcctgtgtggtcaataagcagaccggagatgtcacatgcaactgcactgatggccgggtagcccccagttgtctcacctgcatcgatcactgtagcaatggtggctcctgcaccatgaacagcaagatgatgcctgagtgccagtgcccgccccatatgacaggaccccggtgccaggagcaggttgttagtcagcaacagcctgggcatatggcctccatcctgatccctctgctgctgcttctcctgctgcttctggtggctggcgtggtgttctggtataagcggcgagtccgaggggctaagggcttccagcaccagcggatgaccaatggggccatgaatgtggaaattggaaaccctacctacaagatgtatgaaggtggagagcccgatgatgtcgggggcctactggatgctgattttgcccttgaccctgacaagcctaccaacttcaccaacccagtgtatgccacgctctacatggggggccacggcagccgccattccctggccagcacggacgagaagcgagaactgctgggccggggacctgaagacgagataggagatcccttggcatag

SEQ ID NO: 30 - DNA, 13635 bp, HOMO SAPIENS
atgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctgattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagaagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaagttggcaccaacaaatgccgggtgaacaatggcggctgcagcagcctgtgcttggccacccctgggagccgccagtgcgcctgtgctgaggaccaggtgttggacgcagacggcgtcacttgcttggcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccatcagcacacctgcccctcggaccgattcaagtgcgagaacaaccggtgcatccccaaccgctggctctgcgacggggacaatgactgtgggaacagtgaagatgagtccaatgccacttgttcagcccgcacctgcccccccaaccagttctcctgtgccagtggccgctgcatccccatctcctggacgtgtgatctggatgacgactgtggggaccgctctgatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcgaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctggaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatggctcccaatccctgtgaggccaatgggggccagggcccctgctcccacctgtgtctcatcaactacaaccggaccgtgtcctgcgcctgcccccacctcatgaagctccacaaggacaacaccacctgctatgagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggaagctctactggaccgatggtgacaacatcagcatggccaacatggatggcagcaatcgcaccctgctcttcagtggccagaagggccccgtgggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctggaccataagggcaccaacccctgcagtgtcaacaacggtgactgctcccagctctgcctgcccacgtcagagacgacccgctcctgcatgtgcacagccggctatagcctccggagtggccagcaggcctgcgagggcgtaggttcctttctcctgtactctgtgcatgagggaatcaggggaattcccctggatcccaatgacaagtcagatgccctggtcccagtgtccgggacctcgctggctgtcggcatcgacttccacgctgaaaatgacaccatctactgggtggacatgggcctgagcacgatcagccgggccaagcgggaccagacgtggcgtgaagacgtggtgaccaatggcattggccgtgtggagggcattgcagtggactggatcgcaggcaacatctactggacagaccagggctttgatgtcatcgaggtcgcccggctcaatggctccttccgctacgtggtgatctcccagggtctagacaagccccgggccatcaccgtccacccggagaaagggtacttgttctggactgagtggggtcagtatccgcgtattgagcggtctcggctagatggcacggagcgtgtggtgctggtcaacgtcagcatcagctggcccaacggcatctcagtggactaccaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggactcatgccaacggctctatcaagcgcgggagcaaagacaatgccacagactccgtgcccctgcgaaccggcatcggcgtccagcttaaagacatcaaagtcttcaaccgggaccggcagaaaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaaacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaacctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgaactctctccatgccgaatcaacaacggtggctgccaggacctgtgtctgctcactcaccagggccatgtcaactgctcatgccgagggggccgaatcctccaggatgacctcacctgccgagcggtgaattcctcttgccgagcacaagatgagtttgagtgtgccaatggcgagtgcatcaacttcagcctgacctgcgacggcgtcccccactgcaaggacaagtccgatgagaagccatcctactgcaactcccgccgctgcaagaagactttccggcagtgcagcaatgggcgctgtgtgtccaacatgctgtggtgcaacggggccgacgactgtggggatggctctgacgagatcccttgcaacaagacagcctgtggtgtgggcgagttccgctgccgggacgggacctgcatcgggaactccagccgctgcaaccagtttgtggattgtgaggacgcctcagatgagatgaactgcagtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgtgaaacgccccagatgccctctgaattacttcgcctgccctagtgggcgctgcatccccatgagctggacgtgtgacaaagaggatgactgtgaacatggcgaggacgagacccactgcaacaagttctgctcagaggcccagtttgagtgccagaaccatcgctgcatctccaagcagtggctgtgtgacggcagcgatgactgtggggatggctcagacgaggctgctcactgtgaaggcaagacgtgcggcccctcctccttctcctgccctggcacccacgtgtgcgtccccgagcgctggctctgtgacggtgacaaagactgtgctgatggtgcagacgagagcatcgcagctggttgcttgtacaacagcacttgtgacgaccgtgagttcatgtgccagaaccgccagtgcatccccaagcacttcgtgtgtgaccacgaccgtgactgtgcagatggctctgatgagtcccccgagtgtgagtacccgacctgcggccccagtgagttccgctgtgccaatgggcgctgtctgagctcccgccagtgggagtgtgatggcgagaatgactgccacgaccagagtgacgaggctcccaagaacccacactgcaccagcccagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggatgacggccggacgtgtgctgatgtggacgagtgcagcaccaccttcccctgcagccagcgctgcatcaacacccatggcagctataagtgtctgtgtgtggagggctatgcaccccgcggcggcgacccccacagctgcaaggctgtgactgacgaggaaccgtttctgatcttcgccaaccggtactacctgcgcaagctcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatag

SEQ ID NO: 31 - DNA, 621 bp, CHICK
gtaccccttcaaccccaactcagcctacgagccggccttccagggcgacgagaacgtgcgcatcgatgccatggacatctacgtcaagggcaacaagatctactggaccaactggcacacgggcaggatctcgtactgcgagctgcccgcctcctccgctgcctccaccgcctccaaccgcaaccggcgtcagatcgacggcggcgtcacccacctgaacatctccgggctgaagatgccgcggggtatcgctgttgattgggtcgctgggaacatctactggacagactccgggcgggatgtcatcgaggtggcgcagatgaaaggcgagaatcgcaagacgctgatctcgggcatgattgatgagccacatgccattgtggttgatccacttagggggacgatgtactggtcagactggggcaatcaccccaagatcgagacggccgcgatggacgggacgctgcgcgagacgctggtgcaagacaacatccaatggccaacaggcctggctgtggactaccacaatgagcggctgtactgggctgacgccaagctgtccgtcatcggcagcatccggctcaacggcaccgaccccgtcgtggccatcgacaacaagaa

SEQ ID NO: 32 - DNA, 19519 bp, CAENORHABDITIS ELEGANS
atgattctgaggttgctcattttcacagcgttggctgtaacaaccgccaattcaagtacgcggcaacagtcaacgtttcattcaattcaaggtgagaaggttttgtatttaaaatcgataaaagttctatcaagttaaaaacaattctgtttttttttctggtttcagataaatttttttattattatttcaaaaatctgtaattttcttattgccaggggtagtactccaaatatttatattctataattgtaaattgtaagtccgaattctctgcaccattttatgattgaaaataaaaaaagttgcattctctaaattcttttagattgttaaaaactttctattaaaaaggtttctgttaagtgacaatctttctgaaagatttgggcttttgtaaaattggtttaaaaaatatttaccgttttctaaaattatgaatggcagagactgagtatttgccattttttgactggaaattaatattattttgaaaagtttcaataatttcttgactggcgttcaaataatttatttcccgtagttttttttgttgaaatttgggccctgcctccagacatttcaaacttgacctctctacatatcaccaaagatagaagcacaaatgttcacaaaaaaggtgcataaaaaacaggaaaagctcaaaaggtgttcaagagtgacctatgtggagcattgcttcgtgaggttcggcgcacttttgtctgcacgagaagcatactcgcgcacctcatagcacaaataatgtctctctctctctcaattggaatagagaaaagtctcagagttagaacaacaaaccaacaaaagtgaacaaatatatgataatattcgacaaaggaatatacactattaaaaacattaattgttccaagaatttcgaggttttcatgatcttttcacatcttattttaaagatggaatagcgccactagggaaaatatttaaaagaattcacaatggtttttggcaaatcaggtctttttcaaaatttaccagcaacattaaaaattatttccaattcattcaaatattttccttttttctactttttgttttgtttcaaacaaaatttgtcatcatatttttcctcgcctccgaagttttcaagcggtgtaaattaaagtgtgattagtatttgtttgttgatgtggttactgaatgatacaagtttttttgaccatcgtttttcaaacaatcattccaaaaaaagtgacaaaaaagggaggaaaactggcttcaaccccatagatgaccactacaccgtgtcaaacatttgatttagttttagacagcttttggtctgcccttgtgatgtttaatcttaagttacaatgtcaaaaggatagaaagatcggatagtagggtttccagtcgttgttccaggagtgcgcggaaattaaaattattttgcaatttttcttcctcgttaaaataatttggaaactgtaaagcaaagattttgaaaaatgattcagaaaaatcaacaaaaagtatttattttttatgtagagatttcgttcatctctttgaatttttaaatgtcaataggcttggtatatcacagaacagttaagtaccgtaacttttggaatatttcagagctttttagaaatcaatgtgatgaacaatattttctgccaaaaatgtttaacatttaaacgaaaacatgcaaccccaaaaaaatggaacaatacaaattgacagtaggctgaaagcaatctaaaatttttgcagttgactcaccgccatcagttcgttctcgaataatatctgcatcagtaaacacagcttcatcagtatgcaacgagaatgactttagatgtaacgatggaaaatgtatacgtaccgaatggaaatgtgatggatctggtgattgttcagatggcgaggatgaaaaagattgccgtaagtttgaatataaaaatgttcccaaatcttttggtctgtttcaaaaattcatttctacgagactaattgcgacaatttttttgcgaaaataataaaagttgttaaattctcgaacccactcctcaattttcagcacatcctggctgtaaatctgatcaatggcaatgtgatacctacacatggcacagtgtctcatgtattgccgaatatcaaagatgtgataacatcactgattgtgcagatggatcagatgaaaaggattgtcgtgagttttttgctttaatgttcaaattgagaaggcttatttataataatctgaattaaaattttcagctgcttcaactgtggactgcagttcccaaaatgtatttatgtgtgctgatgggagacaatgttttgatgtgtcgaagaaatgtgatggaaaatatgattgtagagatttaagtgatgaaaaggtaattttcaacttaaattagttatttttttagttattcttaattattttctcaggattcttgttcccgaaatcacacagcctgcttccaatatcaattccgttgtgctgataagactcaatgcattcagaaatcatgggtttgtgatggatcgaaagattgtgctgatggatctgacgaacctgacacttgtggtacatacctgaaaattagaagtttctttctgaaaatatgatatttcagaattcaaaaagtgtacggccaatgaattccaatgcaagaataaacgttgtcaacctcgaaaattccgttgtgattactatgatgattgtggtgataactcggatgaagatgaatgtggagaatacagatgtccacctggaaaatggaattgtcctggtactgggcattgtattgatcaattgaaactttgtgatggatcaaaggattgtgctgatggagctgatgagcaacagtgttgtaagtttttcaatttaaataaaatgaagtaggtaggcttgaagtaggcactacgcaggcatgtaggcaggcatggaaagactaggtatgaattaggcgtaaagtaggtaggtacaaggtagaagtaggtacatcataaatgttccacaattttttagtcgattgccaatattatctttgtttttttcaaaaaacggtttcaacaaaaatataagttctaactgcctaattttctattgcataaaatgccatttgccgaaagatcgcgcgtccaaagatcagtaacgtcttttttatcactgaaatcccattaaataaactaccgattaaaaatgtatatgattgcagcgcaaaacctgtgcccatcacttggttgtcaagcaggttgccatccatcaccacatggaggtgaatgtacgtgcccaagtggatataaactcgatgatcgtttccatagaacatgttctgatatcaacgaatgcgctgaatttggatattgtgatcaattatgtgcaaatcatcgtccaggcttcacatgctcatgtcttggagactgttttacacttcaaatggaacatggtccaggaaaagataacctgacaatgagaggatattgtgtatcaaataatgctgataaaatgaaacttttcgttgcaagaagagagggtctctacagattaaatcctaaaaatccagatgaagaagtcaagaaattggcttctggagaattcatttatggtattgactttgattatggagatcgtaaaatcttctggactgatcgtcttgctcattctgcattcagtgctgatgttgatgatgagggagaaatttcacaaatcaagttagtttttttctaccaaatttaacttaaattttgaaacaaatttattagaaatatcccaatttttaatttgaattcagcaaatatactttgtggctttcgagaaacttgaacttacgttgtatatttcagaaagttgagcttgaaatctcttgtctatccacgttgccttgccgttgattggattacaaataccctttacatcattgagtctggatcaagaagaattgatgtatcatcatatgatggagaacgaagaacagttcttcttgctgatggccttacacttccacttgatattgctcttgatccactcagagggtatgttttattctaaacggtcaaattttactctgtaatttcagagaaatgttcttcacaaatcagctcaaacttgaagcagctgcaatggatggaacaaatcgtcgaacattagtgaacacacatactcatcaagtatctggaattgttgtggatataactgcaaagagggtttactgggttgatcctaaagttgatcgacttgaaagtattgattatcaggtacggggactttgatcaacatttgaaagtgtgattttttttcttaatctgttggaaaacgcaaagcatgccatatatgtatattatagagacggtacttaccttttacatatatttcttcaaatatgattaatagtaagtcaaacaggttacaataaaaatataatactgttagagtaatgtttttcaatttaaatgtctgcgaataaaatcatttttttagggaaatgatcgtcgaattgttgctcaaggaatgaacgttgtcccacatccattcggcttggcactatttgatcaatatctttattggactgattggactcgtctcggagtaattcaagtcgaaaaattcggatccgatactaaattgttgtggagtaacactgagaataatgtattcccaatgggaatatctgcataccatccaatggctcaaccaggtcctggacaatctgaatgccttgcaatgaaaattgagaatccatgcacaaacgcagattgtgaaggaatgtgtattctatcaaaggataatggaggttttggtgttggatataaatgtgcatgtccaattggtcaaaaactagtaaatggaaagagatgtattgattcaattgattatttgctattctcaagcaataaaattgtgagaggaatattcccagaaatcaatgaaaaagctcttgctgaagctgttctaccaatttctccaatatcacaacgaagaattggaatgtattttgaagttgaatgtgatgttcatggaaattcattcttctatgctgatattatggataatactatctacaggtactttctttgtttatagtgtttggctgagcttttaaatttaaaagtacatgtactttcagatgaaacgtatgtaatttgaaataagatccttttaaaagggatgcatcagcactttgaactagaaaaaagtcggagtgaaattttttggtgcatttttgtactactggcgaagtccgtaaaattgccccaaaagtggagttttgctcatttttgataatttttaagtgtcggaaaagttgtttaaaatttatttttagaaaaaaaacatctgaataatatatttccagaatccgtcctgatggagaaggagctgctccagttcttgtaacccataatgatggactattctcaatgtcatttgattggatcagcaaacaactttactatgttgataatatcagaaatagtcttgaagttgtgaagattggagaaactggattagttcatccagacgaacttgttcgccgtcaacttattacagaacttcgtgatccagtttcagtcgttgtacatccatggaaaggactcttattctatgcagaggcaatgcgacccgctgcaatctacaggttcctaattttcaacgtctcgaacaaattttaaactaaacattttctcagatgccacattgatggacaaaactgccaagttatccgtaacaccactcttggccgcccatctgaaatggctatcgactttgctgaaaatcgtctttgctggggagatactcttctgaaaacgatttcatgcatggactttgatggaaagaatgtggttaagcttgatattgataacccgattccagttgcaattacaattatgaatgaatacatttattatgtacatcaacgaccatattcaattagaagagttcataagaagaatggaggaggaagcaagattgttcgagagtttggagctgatgtgagttatttgaaatagcaaattaaaacaggactgagtattcatatttttcaaaaattaattggtttcttgtaaaacttgtcaaaatattattttttaatcaatataatattttctcacatttcaatattagttattgattttgaaagttagtttatcgtaaacagttttgcaaacaagcatcgctattttgaaatttgttgtctttccgcttagtcttttgatattctgttcaaaacaactaatcccattgtcaaatattaaatctcttcgctttctaattttctatttacaggaaagatcaatcttctctctcaaagcttgttcccatcaaaatcaaccaattcctgatgattcacgagaacatccatgtcgtgcttctcaatgcactcaactttgttttgcaactccttcggaatctcatccaaacgagcttgaagcaaaatgtgcatgtcgtcaaggatttatgatcaataaggaaaataaccatagttgtcagaaagatcccgctgagaaaattgagcaattgtgctcatcgaactcaacacaattccagtgcaagaatggaagatgtattccaaaagaatggaaatgtgatggagaaaatgattgtttggatgaatcagatgaaattgatgagaaaggagacaaatgttttcatgaaacagaatgcgcagagaatacaattaaatgtagaaatacgaaaaagtgtattccagctcaatacggttgtgatggtgataatgattgtggagattattctgatgaagatgttaaatattgtaaagacggacagaagcctgtatgtgctgccaagaagttccaatgtgacaatcacaggtgaatagtttttcattaaaatataaacttggaatggcacttttgtaaatcagaaattgaatctgcttaaatctgaaattctttcatgatatttttttgcactgttttctcgagacctgtagatttactcgaattgtcggttttgaagacattttaatgattttttggttttcaaaactggttaaataatctggaatttttttgaatttttttttcgctaaacgatcggaaaattctttcactcagaaaatttaacctaaattaaaaccttaaacaataaactttagttgacattttagaaaatcagttaattttacagatgtattcctgaacaatggaaatgtgacagtgacaatgactgtggagatggttccgatgaaaaattggaaatgtgtggaaatgccacatgtgctgccaaccaattctcatgtgcaaacggacgatgcattccaatttattggctctgcgatggtgataatgattgttatgatggaactgatgaagacaaggaaagatgtccaccagttcaatgctctgctcttcaatttagatgtgcaaatggtagacaatgtgttccattaagaaatcattgtgatggacaaagcgattgtgaagatggttcagatgaagattcatgtgcagttacagcagaatcttgtacaccagatcaattcaaatgtgtatcatctggtctttgtattcctgcttcatggaaatgtgatggtcaacaggattgtgatgatggctccgatgagccaaagttcggatgtactagtggaagacaatgtagttcggatcaattcaaatgtggaaatggtagatgtatccttaatgtgagttcatgtttagagctaaactattaaattcattcttaaaacattttagaactggctttgcgatggtgagaatgactgtggtgatggttctgatgaatcatcagaacgtggatgtaagacttcaatgaatgcaagaaaatgtccatttgaacatgttgcttgtgaaaatgaccaagaaacttgcattccacttcatcaactttgtgatggaaagacccattgtcctggtggaactgacgaaggtggaagatgtgctcgtgacttatgctctgctgacagagctggatgctcattcaagtgtcataacagtccaaatggaccaatttgcagttgtccattcggtgaacaggtttgtaattcatctatataactgcagttaaatgcttccatttttcagcttgtgaacaagaccaaatgtgagccagaaaacgaatgtttggattccagcagttgttctcaaagatgtaaagatgaaaagcatggattcacatgttcttgtgatgaaggatatgaattggatgttgataagagaacctgtaaggttgctgataatgtgaaggataccagaatctatgtttcaaaccgaaatagaatctactacagtgaccataaacttgacaattggcatacttttggagcaattgttgaaaatgcaatagcacttgcttgggatagtttaacggatcgaatttattggtcagatattcgagagaagaaaattttatcagcaaacagaaatggaacaaatgcaacagttttcattgctgatggacttgatatcactgaaggaattgctttggattgggttggaagaaatctttattgggttgactcttcattaaatacaattgaagttgcaaatcttgaagatccaaaacaaagaactcttctcgttcatcaaaatgtcagtcaaccacgtggaattgctgttgatccacgtaaaggtgtcatgttctggactgattggggacagaatccatgtatcgagagagcttcaatggacggaacagatcgtcagattattgtaaaaacaaagatctattggccaaacactattgccttggattatactactgatcgagtttactttgccgattctaagcttgactttatcgattttgtgaattacgatggaagtggaagaactcaagttttggcttcatccaaattcgttcaacatccacatgctcttgctatctttgaagatatgatgtattattcggatagaagacttcaaaaattacaagtttatccaaaatatccaaatggaacaacatcggaatacccaagtcatacattcagtaaggctttgggagttgttgcagttcatccagtacttcaaccagttatcaagaataatccatgttcaacgaatccttgcagtcatctttgtcttcttaataacaagaacgtgagttttttttttgattttactcaggaaatacattcctgataaggcaatttactgaacttatttccggatttctcaatgaaacatttgccatttgaaaaattaccattctaatccctacaaaaaatattttatccttaaattttagacattcacctgcaaatgcccaatgggagagaaattagatgcatctggaaagaagtgcattgacgacgcaaaaccattcctcgttatcattcaaaaaactaacgttttcggaattgaaatgaactctgcctcgtaagtatagcctctaacgtgtttgaaatctatttttctttctgaaactcattattttaaattttcagagaaaaagaaaccccagttctcgctggaatggttccactatctggtcttggaaatgcatttgacgctgcctatgatgctttaagtgaagaaatgttcattttggagcatacaaatcatgccaaaacacttgctcaaatcacgactgattctgcaatttatcgaagcactgttaacggtggaaacaaaacaaaaatgttctcgtcggcagttcctgatgatgcatattgtcttggttttgattggaatgggagaaatttggttgttggaaacaagattactcaaacaattgaaattattcggactcaaggaaaacaatatcgatctgtaattctatcaaatgatcaatcaccaactgccgtagtgactcctgttgcaattgctgttgatgcagataagggatacgttttctggcttgatagaggaggtggtgctgctgatgcaaaggttgctcgtgctggattagatggaagtaatccattggttattgcaagcaatgatttggcagaactcgatcatattgcaattgataccactaatacaagagtttacttctcggaagctaaagctggaagagttcgttcttttttgttacgaaactctagaatagttttcctacccgaacacctagtttttcaagttcttttctgcaaactgatggcacatttttctattcgacaattctaattaaatactacagaaagctcttattttattctgctttctccattctagagtgtaacattttattgcccatttcaaattttaaaatgtttagatttcatcagtcacctacgatggtcaagatcgtcattacgtgctcagtgatggtggacgtcaaccaaatggacttgcattctatggagatcgtctcttttatgctgattcggcatttgattcaattgaggttgccacaatcaatggtgattctcaaccaccacagtggacacatttcaagaaggatgttgagaatttggctaatattaaggcattgcaacctagagcatgtaagtatttcagtttatttttgtttttggaaaattcaaagtggaatattttagcatcaagcggtcacccatgtcatattaacaatggaaactgtgatcatatttgtattccacttatgtttgcccagaggacatgtacatgcgccaatggatatgttaaggatgggcagacttcgtgtaaactctttgatgaatcatttgtcattgtcgctacaaagaccaaggttattggatatccgtaagtttcttattctcgatgacattgaattgaaaacaatattgaaaaaaaagaaaaaaatttattttcagaatcgacgaaacacaatcaaaaggagttgcaatggagccaatcggaggattatccatcacaggagttgattatgattatgaatcaaagactatctacgtggcagaagcatctggaattaacaagggaattactgcctacacaattggagaatcttcaccaagagctgttatcagagattctattggatcattgacaatcaagagtttagcaattgattggattaattacaatatgtactttattaatcatgatgctgaacgtacgaatattgaagtgtcgaagttggatggaacttatcgaaagattctattaactactaaaactgaaactccatcatctattgctgttgatccagttagtagatatttgtattgggctgatcaaggacaaaaaccaacaattcaaagatctttccttgatggatcaagacgtgaagtgattgtttcatcgggaattgctgaaccaactgatttagttgtggatgttgccagtaaaatgatttattggtcggatgccaagatggatggaatctaccgtgtaagaagcaccggtggaacgccagaacttgtaagatcagacattgcatctgctgctggagtggctcttcacggacagaacatgtactggacggataacagacttgaaaaactattccgagcaacatcgaagcctaatcagacatctcttctcctttctccaactactgttgctgcttctctcaaggatattggtgacgtggcagtcttctcatccaacaatcaaccaagagcaagttctccatgtcaaatcacagataatttgagaaagagtccatgtactcaattgtgcttcgccactcctggaactcaaactccaacttgttcgtgcgcacgtggtgttctgaagggaagaacatgtgaagaaccagacacttatattatgttctctgatggtgataagattattgatgttgcaattgaaccagatgtcaaagcatcacgtccattgaaggatccattcccagagatttccaatcttcaaactttcgatgttgatgtcaatttgagaagagtatactttgttgtcgaatctccagttggagttaacatttcttggttctcaatgaacaacgcggagaatccaagactcgtgtttggagcttcaaagcaaccacatgcaaaggagattcgtcatatttctgatatgaagcttgattggttgacacagaagatctattttacaactggaagaggtggaaaagtgatggcaattgatacagctggagaacatctttcaacaattgcatccggagattggacatatgcattggccattgatccatgttcaggacttttgttctggtcggatagtggatataagacaagtggaggtctttatgaaccaagaatcgaaagatctaatcttgcgggtggaagccgaaaagtcattgtatcagagtccatatctcttccagctgccatcgctgttgacttcagaaatcagaaaatctactgggcagacgttaatcgtttgaatatcgaagtcgcagattatgatggtcaaaaccgaaaggtgattgcttcgggatatcgtgcaaagtcattggatatttgggatagatggctctacatgagtgatcctctcagtaatggcgtcttccgtatcgataaggaatctggttcaggcctcgagaatgtggtttctgatcgtagaatcccaggtgctcttcgtgtatttgcgagcgaatcagatgttcgtacacgtaatcaagtgtgcaatgcattgacttctcaactctgcaagactgataatggaggatgtgatcagttgtgtactgtcgttgctgatgatattggattggctgcaagcaaggttcaatgttcatgtaatgatacatacgaacttgtacaagaaccaggaaaggactatccaactcaatgtgttctccgtggaagtaactctgaacctgcaaaagaatgtcttccaccatacaatttccaatgtggagatggctcatgcatcttgctcggcgcaacgtgtgattctaaaccagattgtgcagatgcttcagatgagaatccaaattactgtaacactcgttcatgtccagaagattacaatctttgtaccaaccgacgatgcattgattctgctaaaaagtgcaatcacattgatgattgtggagatggatctgatgaacttgattgtccatctgcagttgcttgtgctgaaggtacattcccttgttccaatggacattgtatcaatcagacaaaggtttgtgatggtcacaatgactgtcatgatgaacaagtatccgatgagtctcttgccacgtgtccaggacttccaatcgattgtcgtggagtgaaagttcgttgtccaaacacaaacatctgtattcaaccagctgatctttgtgatggttatgatgattgtggagataaggctgacgagaatcaattgttctgtatgaatcaacaatgtgctcaacattatgtcagatgcccatctggaagatgtattccggagacatggcaatgcgacggggacaatgattgctctgatggatgggatgaaacacatacaaattgcactgatactgcaggaaagaagatttgtgttggagattatctattccaatgcgacaatcttaaatgtatatccagagcatttatttgtgacggagaagatgattgtggagatggatcagatgaacattcaagacatggatgtggtaacagaacttgcacagatcaagaattccactgtacctcgaatgcaaaactagctcaaccaaaatacgagtgtattccgagagcatggctttgtgatggagatgttacttgtgctggaggagaagatgaatcaactgaactctgtaaaacagaaaagaaagaatgcaataagggagaattcagatgtagtaatcaacattgtattcattcaacatgggaatgtgatggagataatgattgtctcgatggatcagatgaacatgctaactgtacttattcatcctgtcaacctgatttcttccaatgtgccaatcataaatgtgttccaaattcatggaaatgcgatggaaatgacgattgtgaagatggttcagatgaaaaagattgtccaaagaattctgcatctgcacaaaaagcatcaaaatgttcaaacggtcaattccagtgtacttcaggagaatgtattgatgacgcaaaggtctgcgataggaactttgattgtactgatcgatccgatgaaagctctctttgttgtaagttttttagtttattttgaaaatattttggaacggcctgtatctagatttataaaacaccgttttctatttcaagagtattttgttcaagtcttagactttttgaaaaatatctaaagttggctatttcagtcatcgatgaatgctcacttgctgaaaaaccactttgtgagcagaaatgtatggatatgaagattggatacaaatgtgattgtttcgaaggatttgcaattgatatttcggatcaaaagagttgtcacaatgttaatgaatgctatggtaagttatttgataagagttgagaatgttttgaattttaaaagatttttttaaagtataattagaccctaaaatatgcaggactaacttaacattttagaaaattcgtctggcgttttcagttttaaacttcactttccaaattgaaacattttcttgccgactgatttattgatttttctgaaaatttgccacaaatattatattgaatcgtttcgaaacctaattttatttcagaaggaatctcgggatgcagtcaaaaatgtgatgataagataggatcttacaagtgtggttgtgtcgatggataccaactatcaagtgatgatcacagctgtaaaagaactgaaatggaaccggaaccattcttcctgcttgcaaataaacattacattcgaaagatttcaatagatggaaataaatatgaattggctgctcaaggattcgataatgttgtatctttggatatagatcttactgagaagaaggcatacttgattgatcaaggaaaactgagacttttgagggttgatcttgatgaaatggattctccactgtcatcttatgaaactgttttgaggcataatgtttatggaactgaaggaatcgctgttgattgggtcggaagaaaactgtatatgcttaatcgacaagaaagatcaattagagtgtgtgaacttgatggaagattctgtaaaactcttattcgagacagaattcaacaaccaaaggcaattgttgtacatcctggaaagggatatctcttcttcactgaatggtctcttcaaccttatattggaagaattgctctcgatggatctccagaacttcaagatccaatcttcaagctcgcagagcatgatcttggatggccaaatgcaattgcaatcgattatttctcggatcgtctcttctggggtgatgctcatctcaacgagattggattcatggactttgatggaaatggtagaagacacattcctgctcaacgtaccagtcatgtttcatcaatggttgtctttgatgattatttgtattgggctgattggaatttgagagaagttctgagatgtgataagtggacaggaaagaatgaaactattctcaagaagactgttcaacttccgaatgatttgagaattgttcatccgatgagacaacccgcgtatccaaatccatgtggagataataatggcggatgctcacatctttgtcttatcggagctggaggaaatggatacacatgttcatgtccagatcaatttgtattactctctgatcagaagacttgtgagccaaattgtactgaaagacaatttgcgtgtggtggagacgatgccaagtgtattccaaaactttggtattgtgatggagaaccagattgccgtgatggatccgatgagcctggagagagcatctgtggccagagaatctgtcctgttggagaattccaatgcacaaatcacaattgtactcggccattccaaatctgcgatggaaacgatgattgtggtgacagttccgatgagcaaaactgtgataaggcttgtgatccatggatgtttaagtgtgcagctacaggaagatgtattccaagaagattcacgtgtgatggtgatgatgattgtggtgatagatcagatgaagctgatactttatgtatgtcagcagaaagaaattgtactgccgaagaattcagatgtaataataacaaatgtattgcaaaggcatggagatgtgataatgatgatgattgtggagatggttctgatgaaacacctgaatgtgctcaaattgaatgcaagaaaggatggactagatgttcatcttcttacagatgtattccaaattgggcattctgtaatggacaagacgactgtcgtgacaattctgatgaggataagcaacgttgtcctacttgtgatgatgttggagagttccgatgtgcaacaagtggaaaatgtattccaagacgttggatgtgtgacactgaaaacgattgtggagataactccgatgaattggacgcaagttgcggtggaaccactcgtccatgttcagaatccgaattccgatgtaacgatggaaaatgtattcctggaagtaaagtgtgtgatggaacaattcaatgttcggatggacttgatgaatctcaatgtacacttagaagatgtttacctggacatagacaatgtgatgatggaacatgtattgctgaacataaatggtgtgatagaaagaaagattgtccaaatgctgctgatgaattgcattgtgaagatgtggtacgtttactttttattgactgaaaactgatacagacggaacctacagagttcttgttaacttgttggtttccttctcattattaggcaaattaaaaagaacatagaacaaaaatacgaaataaattcgttgagtacataaaaatttggtgtagcggcgcaaaaaagccaatatatataagttccatcgcctccccactaaacttcaaataattacagtctcgccgtacttgctctccattcgaatttgaatgtgccaactccgtgtgcattccacgtaaattcatgtgtgatggtgacaatgattgtggagacaactcagatgaaacatcatcagaatgcagaagtgctcaatgtgatccaccacttcgattcagatgtgctcattctcgtctctgcttgaatattcttcaactttgcaatggtttcaatgattgtgggccaaatgatttctccgatgagcatttgtcaatgtgctcaagcttctcagaatacggtgattgttcatctgatcaattcaagtgtgccaatggaaaatgtgtgaatggaacagtggcatgtgatagaaaggatgattgtggagatgcttctgatgaaattggatgctgtaagtttcaatgatttcagtacttgtagaatttttcaataaacttcaaatatttcagcaaagcacggaggaaagacaagctgcgaagccttcggtaacaacggtggttgcaaacatatctgtacggatgtccgtgatggattctactgtcattgtcgtgatggattccgtccagatccacagagtccaaaggaatgtattgatattgatgaatgtgctggaaacaatacttgtactcaattgtgcttgaacactaaaggatcatatctgtgtagatgccacgaggattatgagaacaatgtagttgttggatcaatgactggaaaggattgccgtgcaaagggagatgctgcaaatgtaatgattggagctgatgattctcttgttcaattatcacttcatggatctggtacaaatagacatgcagctgcaaaagcaaatgatgatgataatgatatcattggaattgcatttgatccaagaaaagaattgatgtactggattgatggaagtgaacgaactatttatagatcagcaattgcaaatggaaatcaaagtcatgaaggacagaaattggatgttgactttgcagcaatgggtgtagttccgactgcaattgcagttgactatacaactggaaatttgttcatcgcagctgtttctgagaatatcgaaaatggacttgtaactgcaagaaagaagagaatgtctgaaccaatcgataatcaaaatactggattcatttttgtctgtcttccggatggacgttacctcaaaaagattgtcgcaggacatctccaacaaccaactgcactcatcacagctccatctgccggaagaatctgttattctgatgcaggacttcatgcaaaaatagaatgtgctgatatggatggaacacatcgtcaaatcattgttaaagatcttgtattctctccaacttcaatggcaatcgatgaaggaaagggaaatcgaatctattgggtcgatccaaaatacagaagagttgatgcagtgaatattgatggaagtgaaaggactactgtagttcatgatagacatattccatatgcagttgatgtatttgagaatcatatttactggttgagcagagaatcaaaaactctttatgttcaagataaattcggaagaggaagagtttcagtgttggcatctgacttggaagatggtcatactgtaagagtaagtcaaaagtatgcaaaggatactcaacgaacagttagtggatgtgaaagagctcaatgttctcatctctgtgtttctcttccttcaactggatttgcatgtctctgcccagatggaatcgttcctcaacttgatggatcatgtgcaacacaacatgttgaagcacttacaatgccaaaacaatgtaaatgtacaaatggaggaaaatgtcgattggatggttcatgtgaatgtacatctgattttgaaggagatcaatgtgaaaaggaatcaagtgtcagtcgaaagattattggaactctttctgagaatttcattaccgttctactttatattcttgcattcctatttgcatttggacttattggattctgtgcattgaatctctataagagacgtcaattgctatttaagaagaatgaagctgctgatggaagtgtttcattccacggaaatgttatctctttcagtaatccagttctagaaaacaaacaggttagtttttaaggttttcatcgattttaattaaatttttattccaggatgcaccaggaagtgaattcaatatgcaacagatgacatcaatgcacgacgattcgacaacattcacgaatccagtgtatgaattagaagatgttgatatgtcatcaccaccaccatcaaatgatcagccatccacgtcagcatctgcaatgtcaccaaacagaccatcaacgtctgctgcgtcatcttttgtgccaccaacatttgatcaagatgagattgaattaaagactgctgatgagattattggtgagttgcaataagaattactgtgatatgtgatattactgatatctgacgggctcacatggtggcaggctgtcccataactacaataaaataagttacgcacaaaaaagtgtgacgtcgtacgctctcaccttgcgcactggttaaaaacgatgtgtctcaattcccgcattttttgtagatcacaatagattaaagtaaattaaacgaatatctgaagtataataatttctatttgcagtcccaaaagcggaaatctcgaagccaccaattccagctcgacccaaaaaggagaaagctgatcctctacgagtagacaatccactttatgatccagattcagaagtttctgatgtctaa

SEQ ID NO: 33 - DNA, 8604 bp, HOMO SAPIENS
atggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgtgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcgaatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcagccactcacacgtgcagcagcagtga

SEQ ID NO: 34 - DNA, 13983 bp, RAT
atggagcgcggggccgcagcggcggcgtggatgctgttgctggcgatcgctgcctgcctggagccagtcagtagccaagaatgcggcagtgggaattttcgctgtgacaatggatactgtatccctgcgtcctggaggtgtgatgggaccagagactgtttggatgacacagatgaaattggctgtcctcccaggtcctgcgaatcaggccttttcctgtgtcctgctgaggggacctgcatccctagctcctgggtgtgtgacgaggataaggattgttcggacggtgcagacgaacagcaaaattgtgctgggaccacgtgctcggctcagcagatgacgtgctccaacggtcagtgtattccgagcgaatacaggtgcgaccatgtcagcgactgccccgacggctctgacgagagaaactgccattatccaacatgtgatcaacttacttgtgccaatggagcctgctataacacgagtcagaggtgtgaccaaaaagttgactgcagggattcctcggacgaagctaactgcactaccctgtgttcgcaaaaagaatttgaatgtggcagtggagagtgtatccttcgcgcctacgtctgtgaccatgacaatgactgcgaagataacagcgatgagcgcaattgcaactatgacacctgcggaggtcaccagttcacttgctccaatggccagtgcatcaaccagaactgggtttgtgatggagatgacgactgccaagattctggtgatgaagatggatgtgaaagtaaccagagtcatcataggtgttacccaagagaatgggcgtgtcctgggtctggacgatgcatctcaattgataaagtttgcgatggagttcctgactgtccagaaggagacgatgagaacaacgtcacaagcggaagaacctgtggtatgggtgtctgctctgtcttaaactgtgagtaccagtgccatcagacgccatttggaggagaatgcttctgccccccaggtcatattatcaacagcaatgacagccgtacttgcattgatttcgacgactgccagatatggggaatttgtgaccagaagtgtgaaaaccgacagggccgtcatcagtgcctctgtgaagaagggtatatcctggagcgagggcagcattgcaaatccagtgactccttcagtgcagcctctgttatcttctccaatggtcgggatttgctagttggagatcttcatggaagaaacttccggattctagcagagtctaagaaccgaggaatggttatgggagtggattttcactatcagaaacacagagttttttggacagaccccatgcaggaaaaggtgttttccactgacatcaatggcttaaatacccaagaaattcttaatgtttctgttgacactccagagaatctggctgtggattggattaataataaactttatctggtagagacaaaggtcaaccgcattgacgtggtcaacttggagggaaatcagcgtgttactctcataactgaaaacttagggcatcctagaggaattgcccttgatccaactgtgggctatttgtttttctcagattggggaagcctctctgggcaacccaaggtggagagagccttcatggatggtagcaatcggaaagacctggtaacaaccaaagtggggtggcctgctgggatcactctggatctggtgtccaagcgagtttactgggtggattctcgttatgactacattgaaactgtaacatatgacggaattcaaaggaagacggtagctcgtggaggctcccttgttccgcatccctttggaataagcttatttgaggaacacgtgttctttactgattggacaaagatggctgtgatgaaagccagcaagttcacagaaaccaaccctcaagtgtaccaccagtcttccctgaggcctcacggagtgacggtttaccatgccctcaggcaacccaatgccaccaatccgtgcgggagcaacaatgggggctgtgcgcaggtctgtgtcctcagtcacaggacggataatggtggcctgggctaccggtgcaagtgtgaattcggctttgaactggatgatgatgagcaccgctgtgttgccgttaagaacttcctgctcttctcatcgaaaacggctgtgcgtggaatcccattcaccctctccacccaggaagatgtcatggttcctgtcacagggagtccatccttcttcgttggaattgattttgatgcccaacacagtactgtcttctattcagatttgtcaaaagacataatttataaacaaaaaattgatggcacaggaaaagaggttatcacagcaaaccggttggaaagtgttgagtgtttgacttttgactggatctcaaggaatctttactggacagatggaggactaaagagtgtcactgtcctgaggctggctgataagtcccgacgacagataatcagcaacttaaacaaccctcgttccattgtggtgcatccgaccgctgggtatatgttcctgagtgattggttccgtcctgcaaaaattatgagagcatggagcgatggttctcacctaatgcccatagtcaatactagtctggggtggcccaatggcttggccatcgattggagtgcttcacgattgtactgggtagatgccttttttgataagattgaacacagcacccttgatggtttagatagaaaaaggctgggccatgtagaccagatgactcatccatttggactcaccgtttttaaagataatgtgttcataacagactggagactgggtgctattattcgagtgaggaaatcagatggtggtgatatgacagttattcgaagaggcatcagcagcgtaatgcacgtgaaagcctacgatgctgacctccagactgggtctaactactgcagtcagaccacccacgccaacggtgactgcagccacttctgcttcccggtcccgaacttccagcgggtgtgcggctgtccctatggaatgaagcttcagagggatcaaatgacttgtgagggagacccagcccgagagccacccacacagcagtgtggctccctctcctttccctgcaacaatggcaagtgtgtgcccagtttcttccgctgtgatggagtggacgattgccatgacaacagtgatgagcatcagtgcggggtgtttaataatacttgctcaccttcggctttcgcctgcgtccgcggtggacagtgcatccctggccagtggcactgtgacagacagaatgactgtttagacggcagtgatgagcaaaactgccccacacatgccacgtcgtccacttgcccgtccacctccttcacctgcgacaatcacgtgtgcatcccaaaagactgggtctgtgacacagacaatgattgctcggatggctcggatgaaaagaactgccaagcttcagggacctgccagcctacacagtttcggtgccctgaccaccgatgcatcagcccgctgtatgtctgtgatggggacaaggactgcgcggatgggtctgatgaggcgggctgtgtgttaaactgtacgagtgcccagttcaaatgtgccgatgggagttcttgcattaacagcaggtaccgctgcgatggggtttacgactgcagggacaactctgacgaggcaggctgccccaccaggcctcccggcatgtgccacccggatgagttccagtgccaaggagacggtacatgcatccctaacacctgggagtgtgacgggcatccagactgtatccacgggtccgacgagcacactggctgtgttcctaagacctgctcgccgactcatttcctctgtgacaatggaaactgcatctacaaagcgtggatctgtgatggggacaatgattgtagggatatgagtgatgagaaggactgtcctacccagccttttcactgtcctagcacgcagtggcagtgcccgggctacagcacctgtatcaatctgagtgccctgtgtgacggcgtctttgactgtccgaatgggactgacgagtccccactttgcaatcaagacagctgctcccattttaatggtggctgtactcatcagtgcatgcaagggcccttcggagccacatgcctatgcccattaggataccaacttgccaatgataccaagacctgtgaagatatcaatgagtgcgatattccaggcttctgcagccagcactgcgtcaacatgagaggttccttccggtgcgcttgtgatccagaatatacgctggaaagtgatgggcggacttgcaaagtcacaggatctgaaaatccgttgttagttgtagcaagtcgtgacaaaatcattgtggacaacatcactgcccacacgcacaatctctactcgttggtccaggatgtttcttttgtggttgctcttgattttgattcagtcactggtcgtgtcttctggagtgacttactgcagggtaaaacctggagtgtctttcaaaacggaacagacaagagagtggtccatgacagtggcctctctgtgacagaaatgattgcagtagattggattggtcgcaacctttactggacggactatgctcttgaaacaatcgaagtttctaaaattgatggaagtcacagaacagtactgatcagcaaaaatgtcacaaaaccgaggggactcgcgttagatcccagaatgggtgacaatgtaatgttttggtctgactggggccatcaccctcgcattgagcgagccagcatggatggcaccatgcgcacagtcattgtccaggaaaagatctactggccctgtggcttaagcatcgactaccccaaccgcctcatctacttcatggatgcctatcttgactacattgaattctgtgattacgacggacataaccgaaggcaggtcattgctagcgatttggttctccaccatccgcacgccctcactctgttcgaagactttgtgtactggactgaccgtggtactcggcaggttatgcaggccaacaagtggcatggggggaaccagtcagttgtaatgtacagcgttcaccaaccgcttggaataactgccattcatccttcaaggcaaccaccttcccggaatccatgtgcctctgcctcttgcagccatctttgcctgctttctgcacaggcgcctagacattattcttgtgcttgcccttcaggatggaacctctccgatgattctgtcaactgtgtgagaggtgaccaacctttcttgatgtccgtaagagacaatataatttttggaatctcccttgatcctgaggtgaagagcaatgatgccatggtccccatatcagggatacagcatggttatgatgttgaatttgatgactctgagcaattcatctactgggttgagaatccgggtgaaattcacagagtgaagactgatggcagcaacaggacagtgtttgctcctctgtccctgctggggtcttctttaggcctggccttggactgggtatcaaggaacatttattataccactcctgcaagtcggtccattgaggtgttgacgctcaagggagatacgaggtatggaaaaaccctgattgccaatgacggcacccccctcggagttggtttccccgttggcatagctgttgatcctgcacgtgggaaactatattggtcagaccacgggacggacagtggggttcctgccaagatcgcaagtgctaatatggatggaacatctttaaaaattctcttcactgggaacctgcagcatctggaggttgtcaccctggacattcaggagcagaagctgtactgggcagtcaccagcagaggcgtgattgagagaggaaatgtggacggtacagagaggatgatcctggtgcaccatctggcccacccatggggccttgtggtctatggctccttcctttactactctgatgaacagtatgaggtcattgagagagttgacaagtcctctgggaataacaaagtcgtcctcagagataacgttccgtacctgaggggtcttcgggtttaccaccgccgcaatgccgctgactcttccaatggctgtagcaacaaccccaacgcttgccagcagatctgcctgcccgtgccaggtggaatgttctcctgcgcctgtgccagtggctttaagctcagccctgacggtcgctcctgttctccatataactcgttcatggtcgtttccatgctgcccgcagttagaggctttagcttggagttgtctgatcactcggaggccatggtgcccgtagctggccaaggacgaaatgttctgcatgcggacgtggatgttgccaacggctttatttactggtgtgattttagcagctctgtaagatcctctaatggaattcgtagaatcaaacccgacgggtctaattttaccaacgtcgttacctatggcattggggcaaatggaatccggggtgttgcactggactgggcagcaggaaatctttattttaccaatgcctttgtgtacgaaaccctgatagaagtgttacggatcaataccacgtaccgccgtgtactcctcaaagtctcagtggatatgccccggcatattattgttgaccccaagcatagatatctcttctgggccgactatgggcagaagccaaagatcgaacgctcttttcttgactgtaccaatcgaactgtccttgtttccgaaggcattgtcacccctcggggcttggccatggaccatgacactggctatatttattgggttgatgactccttagatttaattgccaggatccatcttgatggaggagaatctcaggtggttcgctatggcagccgttacccaactccctatggcatcactgtgtttggagagtctatcatttgggtggatagaaacttgaaaaaagtcttccaagccagcaagcaaccagggaatacagatccacccgtagtgataagagataagatcaacctgctccgtgacgtgaccatctttgacgagcacgcccagcccctctcaccagcagagcttaacaataacccttgtctgcaaagcaatggtgggtgttcccacttttgctttgccttacctgagttgcctactcccagatgtggatgtgcttttgggactctgggaaatgatggcaagagctgtgctacctcccaagaagatttcctcatctattccttaaataattccctgagaagtttacactttgaccctagagaccatagcctacctttccaagtgataagtgtggcgggaactgccattgcactggattatgaccgtagaaacaatagaatcttcttcacacaaaagctaaactctctccgtggccagatttcctatgtcagcctgtattcagggagcagctctccaactgtcctgctgtcaaatataggggtgactgatggcattgcctttgattggataaatagaagaatttattacagtgacttttcaaatcagacaataaattccatggctgaagatggatccaatcgtgctgtgattgcccgtgtttccaaacccagagctattgtattagatccttgccgagggtacatgtattggactgactggggtaccaacgccaaaatcgagagagccacactgggaggaaacttccgggtccccattgtgaacaccagcttggtttggcccaatggactcgctttggaccttgagactgaccttctgtactgggcagatgctagcttgcagaaaatagaacgcagtactctcacgggcacgaaccgagaagtcgttgtcagcactgcctttcattcctttggcttgactgtctatggccagtacatttactggacagacttgtacaccagaaaaatctaccgggctaacaagtacgacgggtcagacctggtagcaatgaccacacgtttgcccacccagcctagtggtatttccacagtggtcaaaacccagcggcagcagtgtagcaatccttgtgaccagttcaacggaggatgcagccatatctgtgctccaggtccaaatggagctgagtgtcagtgtcctcacgaaggcaactggtatctggccaacgataacaagtactgcgttgtggacacggggacccgctgtaatcaactccagttcacctgcctcaatgggcattgtattaatcaggattggaaatgtgacaatgacaacgactgtggtgatggcagtgatgagcttcctacagtctgtgcctttcacacctgccgatcaacagccttcacttgtggcaacgggcgatgtgtgccataccactatcgctgtgattactacaatgactgcggggacaacagcgacgaggcaggttgcctgttcagaaactgcaacagcaccacagagttcacgtgcagcaatgggcggtgcataccgctcagttatgtctgcaatggcataaacaattgccatgacaatgacacctcggatgagaaaaactgccctccccacacttgcccgccggatttcacaaaatgccagaccacgaatatttgtgttccccgagctttcttgtgtgatggagacaatgactgtggagacgggagtgacgagaaccccatttactgcgcctcacacacatgccgcagcaacgagttccagtgcctctcccctcagcggtgtattccaagctattggttctgtgacggtgaagccgactgtgcagatggctcggatgaacctgacacttgtgggcattctgtgaacacctgcagggccagtcagttccagtgtgataatggcaggtgcatctcaggcaattgggtctgtgatggtgataacgactgtggggacatgagtgacgaggaccagcggcatcactgtgagcttcagaactgttccagcactcagtttacctgtgtcaacagcagacctcccaacaggaggtgcatcccacagtactgggtctgtgacggtgatgcggactgctcggacgccctggacgagctgcagaattgcaccatgagaacctgctctgcaggggagttcagctgtgcaaatggacgatgtgtcaggcagtcattcaggtgtgatcggcgcaatgactgtggagactacagtgatgagaggggctgctcgtacccaccctgccatgcaaatcaatttacgtgtcagaacgggcggtgtatccctaggttctttgtttgtgatgaggacaatgactgtggagatggttctgatgagcaggagcacctgtgtcacaccccagaacccacatgcccccttcatcaattccggtgtgacaacgggcactgcatcgagatggggcgagtctgtaaccatgtggacgactgctcagacaacagcgatgagaaaggctgtggcattaacgagtgcctagattcttcaatcagtcgctgtgaccacaactgtacagataccataactagtttctactgttcctgtctccctggctacaagctcatgtctgacaaacgctcttgcgtggatattgacgaatgcaaggagtcaccccagctctgtagccagaagtgtgagaatgtggtaggctcctatatttgcaagtgtgcccctggctacatccgtgagccagatgggaagagctgccggcagaatagtaacatcgagccctatctcatctttagcaaccgttactatataagaaacttaactacagatggctcatcttactccctgattttgcaaggattgggcaatgttgtggccctggactttgatagagtagaaaagaggctgtattggattgatgcagagaagcaaatcattgagaggatgtttttgaataagacaaaccgggagaccatcataaaccacaggttaagacgtgctgaaagtctggctgtagactgggtcagcagaaaactctattggttggatgccatcttggactgcctgtttgtctctgaccttgaaggtcgacaccgcaaaatgatagcccagcactgtgtggatgctaacaataccttctgctttgaacatcccaggggaattgtccttcatcctcaaagagggcatgtctactgggcagattggggtgttcacgcatacattggaaggattggcatggatggaaccaataagtctgtgatcatctctaccaagatagaatggcccaatgccatcaccattgactacaccaacgatctcttgtactgggcagatgctcacctgggttatatcgagttctctgatttggaaggtcaccaccgacacacggtgtacgatggatcactgcctcacccctttgctcttacgatttttgaagacactgttttttggacagattggaatacacggacggttgaaaagggaaacaaatatgatgggtcaggtcgagtggtgctggtgaacacaacgcacaaacccttcgacatccacgtgtaccatccataccggcagccgattatgagcaatccctgtggtaccaacaacggtggctgttctcatctgtgcctcatcaaagcgggggggagaggattcacctgcgcgtgtcccgatgacttccagaccgttcagcttcgagacagaacactctgcatgcccatgtgctccagcacgcagttcctgtgtggcaacaatgaaaagtgtatccccatatggtggaaatgtgatggccagaaagactgctctgatggttctgatgaaccagacctgtgcccacaccgcttctgccgtctggggcagttccagtgccgggatggcaactgcacgagcccccaggctctgtgcaatgctcgccaggattgtgctgatggctctgatgaagaccgtgttctctgtgagcatcaccggtgtgagtccaacgagtggcagtgcgccaacaagcgttgcatcccacagtcctggcagtgtgactcagtgaacgactgcctggataactcagatgaggacacttcgcactgcgccagcaggacctgcaggcccggccagttcaagtgtaacaatggtcgctgtatcccgcagagctggaagtgtgacgtagacaatgattgtggagactactccgatgagcccatcgacgagtgcacgaccgctgcttacaactgtgacaaccacacagaattcagctgcaagactaactaccgttgcatcccgcagtgggcggtgtgcaatggttttgatgactgcagggacaacagtgatgaacaaggctgtgaatcggtgccatgccatccttctggggatttccggtgtgcgaatcaccactgcatccctctccgctggaagtgtgacggcactgacgactgtggagataactcggatgaggaaaactgcgttcctcgggagtgctcagagagcgagtttcgatgtgctgatcagcaatgcatcccctctcgatgggtctgtgaccaagaaaatgactgtggagacaactcggatgaacgggactgtgagatgaagacctgccatcctgaacattttcagtgtacgagtggacactgtgtgcccaaggcgttggcatgcgatgggagggcagactgtctggatgcgtctgatgaatctgcttgtcctactcgctttcccaacggcacctactgcccagccgccatgttcgaatgtaaaaaccacgtgtgcatccagtcgttttggatatgtgatggggaaaatgactgtgtcgacggttccgatgaggagatccacctgtgcttcaacattccgtgtgaatcaccacagcgattccggtgtgacaacagccgctgtgtttatggccatcagctgtgcaatggtgtggatgactgcggagatggaagtgacgagaaagaagagcactgtagaaaaccaacccacaaaccgtgcacagacactgaatataagtgtagcaatgggaactgcatttcgcagcactacgtgtgtgataatgtgaatgactgcggagacctttctgatgaaactggttgcaatctaggagataacagaacgtgtgctgaaaacatatgtgaacagaactgtacccagctgagcagcggaggctttatctgctcctgcagacccgggttcaaacctagtacttcggacaaaaattcctgtcaagacatcaatgaatgtgaggagtttggcatctgcccccagagctgtcgaaacagcaaaggaagttatgaatgtttctgtgtcgatggcttcaagtctatgagtacccattatggagaacggtgtgcagctgatggaagccctcctctcttgctcctgcctgagaatgtccgaatccggaagtacaatacctcctctgagaagttctcagagtatctggaagaggaggagcatatccaaactattgactatgactgggatcccgagcacataggcctcagtgttgtctattacactgtgctggcacagggctctcaattcggtgctatcaaacgtgcctacattcccaactttgaatctggtagtaacaatcccatacgtgaagttgacctgggcttgaaatatttaatgcagccagatggattagccgtggactgggtcggaaggcatatttactggtcagatgctaagagccaacggattgaggtggctaccctcgatggaaggtaccggaagtggctgatcaccacccaactggatcagccagctgccattgctgtgaatcctaagctagggcttatgttctggactgaccagggaaaacagcccaaaatcgagtctgcctggatgaacggggaacatcgcagcgttctggtttctgagaaccttggctggccaaacggtctttccatagattacctgaatgatgaccgggtctactggagcgactccaaagaagatgtcattgaagccataaaatatgatgggactgacaggagacttatcataaatgaagcgatgaagcccttcagtctggacatcttcgaagacaagctatactgggtagctaaggaaaagggagaagtgtggagacaaaataaattcgggaaagagaacaaagagaaagtgctggtggtgaacccgtggctcactcaagttcgaatcttccatcaactgagatacaatcagtcagtgtccaacccttgcaagcaggtctgtagtcacctctgcctgctgagaccaggaggctacagctgtgcctgtccccaaggctccgacttcgtaactggcagcactgtccagtgtgatgcagccagtgaacttcccgtcaccatgcctcccccatgcaggtgcatgcacggaggaaattgctattttgatgagaatgaactccccaaatgcaagtgttccagtggctatagcggagaatactgtgaggttgggctctcgagaggcatccctccagggacgacaatggctgttctgttgaccttcgtgatagtcatcattgttggagctctggtgcttgttggactctttcactacaggaaaactggctccctcttacccactctgcccaagctgccaagcctaagcagccttgccaaaccctctgaaaatggaaatggggtgacgttcaggtcgggggctgatgtgaacatggacatcggtgtgtctcctttcggccctgagacaattattgacagatccatggcgatgaatgaacactttgtcatggaggtgggcaagcagcctgtgatatttgaaaacccaatgtatgcagccaaggacaacacttccaaagtggccctggcagttcaggggccatcaacaggcgcacaggtgactgtaccagaaaatgtggaaaaccagaattatggaaggcccatagatccttctgagatagttccagagccaaagccagcctcccctggagctgatgaaattcagggcaaaaaatggaacatcttcaaacgaaaacccaaacagacaacgaactttgagaacccaatctacgcagagatggacagtgaggtaaaggatgctgtggctgtggccccccctccgtctccttctctccctgccaaagcttcaaaaagaaatttgactccaggctacactgccacagaagacacctttaaagacactgcaaatctcgttaaagaagattccgacgtatag

SEQ ID NO: 35 - DNA, 2313 bp, HOMO SAPIENS
atggagaagcgcgcggccgcggggctggagggcgcgccgggcgcccgggcgcagctggccgtcgtctgtctggtgaacatctttctcaccgggagactcagcagtgcggttcctgccttagcggcctgcagtgggaagctggagcagcacacggagcggcgtggggtcatctacagcccggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcactgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggtagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttga

SEQ ID NO: 36 - DNA, 2313 bp, RAT
atggagaagcgcgcggccgcggggccggagggggcgccgggcgccagggcgccgctcgcagtcgtctgcctggtgaacctctttctcactgggagactcagcagtgcagttcctgccttagctgcctgcagtgggaagttggaacagcacactgaacggcgaggggttatctacagcccagcctggcccctcaactaccctccaggcaccaactgcagctggtacattcaaggtgaccgtggtgacatgatcaccatcagtttccgaaactttgatgtagaggagtctcaccagtgttccctggactggctcctgctgggcccagcagctccccctcgccaggaggccttccgcctctgtggttcagccatcccaccagccttcatctctgcccgtgaccacgtctggatcttcttccactcagacgcctccagttccggccaggcccagggttttcgcctctcctatatccgagggaagctgggtcaggcatcctgccagacagatgagttccgctgtgacaacggtaaatgcttgcctggtccttggcagtgcaacatggtggatgagtgtggagatggctcggatgagggtaactgttcggcacctgcctcagagccaccaggcagcctgtgccccgggggcaccttcccgtgcagcggagctcgctccacacgctgcctgccggtagagcggcgctgcgacggcacccaggactgcggtgatggctctgatgaggctggctgccccgacctagcatgtggccggcggctaggcagtttctacggttccttcgcctccccagacctgtttggtgccgcccgtgggccttcggaccttcactgcacatggctggtggacacgcaggacccgaggcgtgtgctgctgcagctggagctacgactgggttatgatgactatgtccaggtgtatgaaggcctgggcgagcgtggggaccgtctgctgcaaacgctttcctaccgcagcaaccaccggcctgtgagcctggaagcagcgcagggccgcctcactgtggcctaccatgctcgcgcccgcagtgctggtcacggcttcaacgccacataccaggtgaagggctactgcctcccatgggagcagccgtgtgggagcagcagcgagggagatgacggcagcacaggggaacagggctgcttctcagagccacagcgctgtgatggctggtggcattgtgcgagcggccgggatgagcagggctgtccagcatgccctccggaccagtatccctgtgagggtggtagcggcctgtgctatgcacctgccgatcgttgcaacaaccagaaaagctgccccgatggcgccgatgaaaagaactgcttttcctgccagccgggcaccttccactgtggtacgaacctgtgcatctttgagacatggcgctgtgacggtcaggaggactgccaagatggcagcgatgagcacggctgcctggctgccgtgccccgcaaggtcatcaccgccgccctcattggtagcctagtatgcggactgctgcttgttattgccctaggctgtgccttcaaactctactccctgcgcacgcaggagtacagggcctttgagacccaaatgacacgtttagaggctgagtttgtgcggcgcgaggcgcccccatcctacggtcagctcatcgcacagggcctcataccacccgttgaggattttcctgtctacagtgcatcccaggcttcagtgctacagaaccttcgcacagccatgcgacgacagatgcgtcggcatgcctcccgcagggggccatctcgtcgcagactgggccgcctctggaacaggctcttccaccggccacgggcacctcgaggccagatcccactgctgactgccgcccgtacctcacagaccgtgctgggtgatgggctcctccaggcagcaccagggcctgtaccagaccccccagtgcccaatacagacacaggcagccccagggaggctggagatgggcctcctagtggctctggccatgcaccagaagtggggccttcagtgccgcccccgcccttgaaccttcgagacccagagtacaggccagaggacaaggagagaaaggcctgtgtggaccctctggaagacagtccagcccctgtggacacacctccagagccctgcttggcccaagacccccacccccagactcccactgccagtggcatccaagatccccactcagcagagccactgggggtctgcaggagccctccaccaacctgctccccaatattggaggctagtgatgatgaggccctgctggtctgctga

SEQ ID NO: 37 - DNA, 2580 bp, HOMO SAPIENS
atgaacagtttcctcatcttcgccaggaggatagacattcgcatggtctccctggacatcccttattttgctgatgtggtggtaccaatcaacattaccatgaagaacaccattgccattggagtagacccccaggaaggaaaggtgtactggtctgacagcacactgcacaggatcagtcgtgccaatctggatggctcacagcatgaggacatcatcaccacagggctacagaccacagatgggctcgcggttgatgccattggccggaaagtatactggacagacacgggaacaaaccggattgaagtgggcaacctggacgggtccatgcggaaagtgttggtgtggcagaaccttgacagtccccgggccatcgtactgtaccatgagatggggtttatgtactggacagactggggggagaatgccaagttagagcggtccggaatggatggctcagaccgcgcggtgctcatcaacaacaacctaggatggcccaatggactgactgtggacaaggccagctcccaactgctatgggccgatgcccacaccgagcgaattgaggctgctgacctgaatggtgccaatcggcatacattggtgtcaccggtgcagcacccatatggcctcaccctgctcgactcctatatctactggactgactggcagactcggagcatccaccgtgctgacaagggtactggcagcaatgtcatcctcgtgaggtccaacctgccaggcctcatggacatgcaggctgtggaccgggcacagccactaggttttaacaagtgcggctcgagaaatggcggctgctcccacctctgcttgcctcggccttctggcttctcctgtgcctgccccactggcatccagctgaagggagatgggaagacctgtgatccctctcctgagacctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcagccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccggccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacagacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaa

SEQ ID NO: 38 - DNA, 4842 bp, MOUSE
atgggggccgtgctgaggagcctcctggcctgcagcttctgcgtgctgctgagagcggcccctttgttgctttatgcaaacagacgggacttgagattggttgatgctacaaatggcaaagagaatgcaacgattgtagttggaggcttggaggatgcagctgcggtggactttgtgtttggtcatggcttgatatactggagtgatgtcagcgaagaagccattaaacgaacagaatttaacaaaagtgaaagtgtacagaatgttgttgtttctggattattgtccccggatgggctggcatgtgattggcttggagaaaaattgtactggacagattctgaaactaatcgtattgaagtttctaatttagatggatctttacgaaaagttttattttggcaagagttggatcaacccagagctattgccttagatccatcaagtgggttcatgtactggacagactggggagaagtgccaaagatagaacgggctgggatggatggctcaagtcgcttcgttataataaacacggagatttactggccaaacggactgactctggattatcaggagcggaagctttactgggccgatgcaaaacttaatttcatccataaatcaaacctggatggaacaaaccggcaggcagtggttaaaggttcccttccacatccttttgccttgacgttatttgaggacacattgtactggactgactggaatacacactctattttggcttgcaacaaatatactggcgagggtctgcgtgaaattcattctaacatcttctctcccatggatatacatgctttcagccaacagaggcagccaaatgctacaaatccatgtggaattgataatggtggttgttcccatttgtgtttgatgtctccagtcaagcctttttatcagtgtgcttgcccaactggggtcaagctgatggagaatggaaagacctgcaaagatggtgccactgaactattgctgttagcccgacggacagacttgaggcgaatttctttggatacacccgattttactgacattgttctgcagttagaagatatccggcatgccattgccatagactatgaccctgtagaaggctacatatactggacagatgacgaagtgagggctatccgtcgctccttcatagatggatctggcagtcagtttgtggtcacggcccagattgctcatcctgatggtattgctgttgactgggttgcaaggaacctgtactggacagacactggcacggatcgtatagaagtgacaaggctcaatgggaccatgaggaagatcttgatttcagaggacttagaggagccccgggctatcgtgttagatcccatggttgggtacatgtattggacagactggggagaaatcccaaaaatagagcgagctgctctggacggatctgaccgagtagttcttgtcaacacttcccttggttggccaaacggcttagccctggattatgatgaaggcacaatatactggggagatgccaaaacagacaaaattgaggttatgaataccgatggcaccgggaggcgagtgctggtggaagacaagatccctcacatatttgggtttaccttgctgggtgactatgtttactggactgactggcagaggcggagcatcgagagagtacacaaacggagcgcagagagggaagtcatcatagaccagctgccagacctcatgggactgaaggccacaagtgttcacagagtcattggttctaacccctgtgctgaggacaatggaggatgtagccatctttgcctgtacaggcctcaggggcttcgatgcgcctgtcccattggctttgagctcatcggtgacatgaagacatgcattgtccccgaggctttccttctgttctcgaggagagcggatatcagacgcatatctttggaaacaaacaacaacaatgtggccattcctctcactggtgtcaaagaagcctctgctttggattttgatgtcacagacaacaggatttactggactgatatatcactgaagactattagcagagcctttatgaatggcagtgcactggaacatgtggtagagtttggcttagattatccagaaggcatggcagtggactggcttgggaagaacttatactgggcagacacaggaacaaatcgcattgaggtatcaaagttggacggacagcaccgacaggttttggtatggaaagaccttgacagtcctcgagctctggcactggatcctgctgaagggtttatgtattggactgagtggggaggcaagcctaagattgacagggctgctatggatggaagtgaacgcactacattagttccaaatgtaggccgagcaaatggtctcaccatcgactatgctaaaaggcggctttactggacagacctggacactaacctaatagaatcctcagatatgctcggactcaaccgtgaagttatagcagatgacttgcctcatccttttggcttaactcagtaccaagattacatctactggacagactggagccgacgcagcattgaacgtgccaacaaaaccagtggccaaaaccgcaccatcatccagggccatttggactatgtgatggacatcctggtcttccactcttcccggcaggcagggtggaatgagtgtgcctccagcaacgggcactgctcccacctctgcttggctgtgcccgtcggaggttttgtgtgtggatgccctgcccactactccctgaatgctgacaacaggacctgcagtgctcccagcaccttcctgctcttcagtcagaagagcgccatcaaccgcatggtgattgatgaacaacagagccctgacatcatccttcctatccacagccttcggaacgtccgggccattgactatgaccctttggacaagcagctctactggattgactctcgacaaaactccatacgaaaggcacatgaagatggtggccagggttttaatgtagttgcaaactcggtcgcaaatcagaaccttgaaatacagccctatgatctcagcattgatatttatagccgttacatctactggacctgtgaagctaccaatgtcattgatgtgacgagattagatggacgatcagttggagtggttctaaaaggcgagcaagacagacctcgagccattgtggtaaaccccgagaaagggtatatgtattttaccaatcttcaggaaagatctcctaaaattgaacgggctgcattggatggtacagaacgagaggtcctctttttcagtggcttaagtaaaccaattgctttggctcttgatagcaagctgggcaagctcttctgggctgactcagatctccggcgaattgaaagcagtgatctctcaggtgccaacaggatcgtgctagaagactctaatatattacagcctgtgggcctgaccgtgtttgaaaactggctctattggattgataaacagcagcagatgattgaaaaaattgacatgactggtcgagaaggaagaaccaaggtccaggctcgaattgctcagctgagtgacatccatgcagtaaaggagctgaaccttcaggagtacagacagcacccttgtgcccaggataatggtggctgttcacatatctgccttgtaaaaggagatggtacgacaagatgctcctgccccatgcacttagttctgcttcaggatgagctgtcctgtggagagcctccaacgtgttctcctcagcagtttacctgcttcactggggacattgactgcatccctgtggcttggcggtgtgatgggttcactgagtgcgaagaccacagcgatgaactcaattgtcccgtgtgctcagagtctcagttccagtgtgccagcgggcagtgcattgatggtgcccttcgatgcaatggcgatgcgaactgccaggacaaatcagatgagaagaactgtgaagtgctttgtttaattgatcagttccgctgtgccaatggtcagtgcgttggaaagcacaagaaatgtgaccacagtgtggactgcagtgacagatctgacgagctggactgttatccaactgaggagccagcaccacaagccaccaacacagttggttccgttattggagtaattgtcaccatttttgtgtctggaaccatatactttatctgccagaggatgctgtgtcctcgtatgaagggagacggggagaccatgactaacgactatgtggttcacagcccggcgtctgtgccccttggttatgttcctcacccaagctctctctctggatctcttccaggaatgtctcgaggcaaatcaatgatcagttccctcagtatcatggggggaagcagtgggcccccctatgatcgagcgcacgtcacgggagcctcctcaagcagttcttccagtaccaaaggcacttatttccctgcaattttgaacccaccaccatcccctgccacagaaagatcccattataccatggaatttggttattcttccaacagtccttccacacataggtcctacagctataggccgtacagctaccggcactttgcaccgcccaccacaccctgcagcactgatgtctgtgacagtgactatgctcctagccggaggatgacctcggtggcaacagccaagggctacaccagtgacgtgaactatgactcagaacctgtgcccccaccgcccacaccccgaagccagtacttgtcagcggaggagaactatgaaagctgccccccttccccatacacggagaggagttactcccaccacctctacccgccaccaccctccccctgcacggactcctcctga

SEQ ID NO: 39 - DNA, 4842 bp, HOMO SAPIENS
atgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccattgtggtaaacccagagaaagggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagaacctccaacatgttctcctcagcagtttacttgtttcacgggggaaattgactgtatccctgtggcttggcggtgcgatgggtttactgaatgtgaagaccacagtgatgaactcaattgtcctgtatgctcagagtcccagttccagtgtgccagtgggcagtgtattgatggtgccctccgatgcaatggagatgcaaactgccaggacaaatcagatgagaagaactgtgaagtgctttgtttaattgatcagttccgctgtgccaatggtcagtgcattggaaagcacaagaagtgtgatcataatgtggattgcagtgacaagtcagatgaactggattgttatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggaatgtctcgaggtaaatcaatgatcagctccctcagtatcatggggggaagcagtggacccccctatgaccgagcccatgttacaggagcatcatcaagtagttcttcaagcaccaaaggcacttacttccctgcaattttgaaccctccaccatccccagccacagagcgatcacattacactatggaatttggatattcttcaaacagtccttccactcataggtcatacagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctga

SEQ ID NO: 40 - DNA, 643 bp, XENOPUS
cggattcacggagtgtgttgatcacagcgacgagcagaactgccccatgtgctcagacatgcagtaccaatgcaccagcggccagtgcatcgactcctctctacgctgtaacggagaggacaactgtcaggacaagtctgatgagaagaactgcaatgaagtctgtgcacctgaccagtttcactgcggcaatggacaatgcatcgggaagcaccggcgttgtgatctcagccccgactgcagtgacagctcagatgagcaagcttgctatcccacagaagaaccacctcctccgtcgaccaacaccattggctccatcattggagtgatcctcacagtatttgtggtagggggggtgtatttcatctgtcagcgagttttgtgccgtcgcatgaaaggcgatggagagaccatgaccaatgactatgtggtgcatggacctgcctcggtcccattggcttacgtcccgcacccgagctccctcactggatccttgcctggtatgtcacgtggcaaatccgttatcagcactctcagcattatggctggaagcagtgggccaccgtatgaccgggctcatgtcactggagcgtcatccagcagctcctccagcaccaaaggaacttattttccaccaatctta

SEQ ID NO: 41 - DNA, 2892 bp, HOMO SAPIENS
atgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgatgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgcccgggccccggggccacgtccgcgcccgccgcctgcgccaccgtctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctggtggaaagagcccatccctaatcttcaccaaccggtacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctga

SEQ ID NO: 42 - DNA, 2142 bp, MOUSE
atgctatcggccctccctcttcttttcctcctcctcggaggtgctctggcccgcccagaccggatcactttcccacgttctgcttgtgaggcgcccccagcagtgctctcagaagtacaaggcactttacagaggcctctaggccgggacagccgaagctcccctgccaactgcacctgggttatcctgggcagcaaggatcagacagtaactgtcaggttccagaagctgcatctggcctgtggctcagagcatttaatcctgcactcccctctacagccaccaatctccctgtgtgaggccccttctggccctttgcagctaccagggggcaatgtcaccattacatacagctatgctggggccagagcacccatgggccagggcttcttgctgacttacagtcaagattggctactgtgcctgcaagaagaattccagtgcctgaaccaccgctgcattccagctgctcagcgctgtgatgggattgatgcctgcggggatggctcagacgaggcaggctgcagctcagatccattccctaacctgaacccagcccccgcaccaactctggcctgcaatctcaccttggaggacttttatggggtcttttcttcccctggatattcacacctggcctcagtctcccacccccagtcctgcctgtggctgctggacccccatgatggccggaggctggcagtgcgcttcacagccctggacttgagttacggagatgcagtgcatgtgtatgatggtgctggaccccccgagacccctcgactgctacgtagcctcacccacttcagcaatggcaaggctgtcactgtggagaccctgtctggtcaggctgttgtgtcctaccacacagttgcttggagcagtggccggggctttaatgctacctaccatgtccggggctactgtttaccttgggacagaccctgtggcttgggctctggcctgggggctagtgagaacctaggtgagcgttgctatagcgaggcacagcgctgtgatggctcatgggactgtgccgatggcacagatgaggagggttgccctggctgcccaccagggcacttcccctgtggagctgcaggcacccctggtgccacagcctgctacctgcctgctgaccgctgcaactaccagacgttctgcgccgatggagcggatgagaggcgctgccggcattgccagcccggcaacttccggtgccgggatgagaagtgtgtgtatgagacatgggtgtgtgatgggcagccagactgtactgacggcagtgatgagtgggactgctcctacgccctgccccgaaaagtcatcacagcagcagtcattggcagcctggtgtgtggcctgttgctggtcatcgctctcggctgcacctgcaaactctatgccatccgcacccaggaatacagcatctttgccccgctctcccggatggaggctgagattgtgcagcaacaggcacccccttcctatgggcagctcattgcccagggtgccatcccgcctgtggaagacttccccacagagaaccctaacgataactctgtgctgggaaacctacgttctctgcttcagatcttacgccaggatatgactccaggtggcacttcagggggccgccgtcgccagcgtggacgctccgtccgccgtctggttcgccgtctccgtcgttggggcctgcttcctcgaactaataccccagctcgggcccctgaaaccagatcccaggtcacaccctctgttccctctgaggccctggatgacagcacaggccatgcctgtgagggtggggcagtaggggggcaagatggggagcaggctcctccactgcccatcaagacccccatcccaaccccaagcacacttcctgcccttgctactgtctctgagaccccagggccactaccctcagtgcctgtagaatcatcactgttgtctggagttgtccaggtcctacgaggccgcctcctacccagcctgtggtccccaggccccacttggacccaaactggaactcacacaacagtcctgtccccagaggatgaggacgatgtattgttattgccactggctgagccagaagtctgggtggtggaggcagaggatgaaccattgcttgcctga

SEQ ID NO: 43 - DNA, 2142 bp, MOUSE
atgctatcggccctccctcttcttttcctcctcctcggaggtgctctggcccgcccagaccggatcactttcccacgttctgcttgtgaggcgcccccagctgtgctctcagaagtacaaggcactttacagaggcctctaggccgggacagccgaagctcccctgccaactgcacctgggttatcctgggcagcaaggatcagacagtaactgtcaggttccagaagctgcatctggcctgtggctcagagcatttaatcctgcactcccctctacagccaccaatctccctgtgtgaggccccttctggccctttgcagctaccagggggcaatgtcaccattacatacagctatgctggggccagagcacccatgggccagggcttcttgctgacttacagtcaagattggctactgtgcctgcaagaagaattccagtgcctgaaccaccgctgcattccagctgctcagcgctgtgatgggattgatgcctgcggggatggctcagacgaggcaggctgcagctcagatccattccctaacctgaacccagcccccgcaccaactctggcctgcaatctcaccttggaggacttttatggggtcttttcttcccctggatattcacacctggcctcagtctcccacccccagtcctgcctgtggctgctggacccccatgatggccggaggctggcagtgcgcttcacagccctggacttgagttacggagatgcagtgcatgtgtatgatggtgctggaccccccgagacccctcgactgctacgtagcctcacccacttcagcaatggcaaggctgtcactgtggagaccctgtctggtcaggctgttgtgtcctaccacacagttgcttggagcagtggccggggctttaatgctacctaccatgtccggggctactgtttaccttgggacagaccctgtggcttgggctctggcctgggggctagtgagaacctaggtgagcgttgctatagcgaggcacagcgctgtgatggctcatgggactgtgccgatggcacagatgaggagggttgccctggctgcccaccagggcacttcccctgtggagctgcaggcacccctggtgccacagcctgctacctgcctgctgaccgctgcaactaccagacgttctgcgccgatggagcggatgagaggcgctgccggcattgccagcccggcaacttccggtgccgggatgagaagtgtgtgtatgagacatgggtgtgtgatgggcagccagactgtactgacggcagtgatgagtgggactgctcctacgccctgccccgaaaagtcatcacagcagcagtcattggcagcctggtgtgtggcctgttgctggtcatcgctctcggctgcacctgcaaactctatgccatccgcacccaggaatacagcatctttgccccgctctcccggatggaggctgagattgtgcagcaacaggcacccccttcctatgggcagctcattgcccagggtgccatcccgcctgtggaagacttccccacagagaaccctaacgataactctgtgctgggaaacctacgttctctgcttcagatcttacgccaggatatgactccaggtggtacttcagggggccgccgtcgccagcgtggacgctccatccgccgtctggttcgccgtctccgtcgttggggcctgcttcctcgaactaataccccagctcgggcccctgagaccagatcccaggtcacaccctctgttccctctgaggccctggatgacagcacaggccaagcctgtgagggtggggcagtaggggggcaagatggggagcaggctcctccactgcccatcaagacccccatcccaaccccaagcacacttcctgcccttgctactgtctctgagcccccagggccactaccctcagtgcctgtagaatcatcactgttgtctggagttgtccaggtcctacgaggccgcctcctacccagcctgtggtccccaggccccacttggacccaaactggaactcacacaacagtcctgtccccagaggatgaggacgatgtattgttattgccactggctgagccagaagtctgggtggtggaggcagaggatgaaccattgcttgcctga

SEQ ID NO: 44 - DNA, 6645 bp, HOMO SAPIENS
atggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcaattgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctga

SEQ ID NO: 45 - protein, 206 aa, MOUSE
  misc_feature (95)..(95): Xaa can be any naturally occurring amino acid
  misc_feature (128)..(128): Xaa can be any naturally occurring amino acid
MLPPAIHLSLIPLLCILMRNCLAFKNDATEILYSHVVKPVPAHPSSNSTLNQARNGGRHFSSTGLDRNSRVQVGCRELRSTKYISDGQCTSISPXKELVCAGECLPLPVLPNWIGGGYGTKYWSRRSXQEWRCVNDKTRTQRIQLQCQDGSTRTYKITVVTACKCKRYTRQHNESSHNFESVSPAKPAQHHRERKRASKSSKHSLS

SEQ ID NO: 46 - protein, 211 aa, MOUSE
MQPSLAPCLICLLVHAAFCAVEGQGWQAFRNDATEVIPGLGEYPEPPPENNQTMNRAENGGRPPHHPYDAKGVSEYSCRELHYTRFLTDGPCRSAKPVTELVCSGQCGPARLLPNAIGRVKWWRPNGPDFRCIPDRYRAQRVQLLCPGGAAPRSRKVRLVASCKCKRLTRFHNQSELKDFGPETARPQKGRKPRPGARGAKANQAELENAY

SEQ ID NO: 47 - protein, 211 aa, MOUSE
MQPSLAPCLICLLVHAAFCAVEGQGWQAFRNDATEVIPGLGEYPEPPPENNQTMNRAENGGRPPHHPYDAKDVSEYSCRELHYTRFLTDGPCRSAKPVTELVCSGQCGPARLLPNAIGRVKWWRPNGPDFRCIPDRYRAQRVQLLCPGGAAPRSRKVRLVASCKCKRLTRFHNQSELKDFGPETARPQKGRKPRPGARGAKANQAELENAY

SEQ ID NO: 48 - protein, 211 aa, MOUSE; identical to SEQ ID NO: 46

SEQ ID NO: 49 - protein, 205 aa, MOUSE
MQPSLAPCLICLLVHAAFCAVEGQGWQAFRNDATEVIPGLGEYPEPTPENNQTMNRAENGGRPPHHPYDAKDVSEYSCRELHYTRFLTDGPCRSAKPVTELVCSGQCGPARLLPNAIGRVKWWRPNGPDFRCIPDRYRAQRVQLLCPGGAAPRSRKVRLVASCKCKRPTRFHNQSELKDFGPETARPQKGRKPRPGARGAKANQA

SEQ ID NO: 50 - protein, 213 aa, HOMO SAPIENS
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 51 - protein, 213 aa, HOMO SAPIENS
MQLPLALCLVCLLVHTAFRVVEGQGWQAFKNDATEIIPELGEYPEPPPELENNKTMNRAENGGRPPHHPFETKGVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 52 - protein, 206 aa, CHICK
MLLSAIHFYGLLLACTFTRSYSAFKNDATEILYSHVVKPAPASPSSNSTLNQARNGGRHYAGTGSDRNNRVQVGCRELRSTKYISDGQCTSINPLKELVCAGECLPLPLLPNWIGGGYGTKYWSRRSSQEWRCVNDKTRTQRIQLQCQDGSIRTYKITVVTACKCKRYTRQHNESSHNFEGTSQAKPVQHHKERKRASKSSKHSTS

SEQ ID NO: 53 - protein, 213 aa, RAT
MQLSLAPCLACLLVHAAFVAVESQGWQAFKNDATEIIPGLREYPEPPQELENNQTMNRAENGGRPPHHPYDTKDVSEYSCRELHYTRFVTDGPCRSAKPVTELVCSGQCGPARLLPNAIGRVKWWRPNGPDFRCIPDRYRAQRVQLLCPGGAAPRSRKVRLVASCKCKRLTRFHNQSELKDFGPETARPQKGRKPRPRARGAKANQAELENAY

SEQ ID NO: 54 - protein, 348 aa, MOUSE
MLASVAGPISLALVLLALCTRPATGQDCSAQCQCAAEAAPHCPAGVSLVLDGCGCCRVCAKQLGELCTERDPCDPHKGLFCDFGSPANRKIGVCTAKDGAPCVFGGSVYRSGESFQSSCKYQCTCLDGAVGCVPLCSMDVRLPSPDCPFPRRVKLPGKCCKEWVCDEPKDRTAVGPALAAYRLEDTFGPDPTMMRANCLVQTTEWSACSKTCGMGISTRVTNDNTFCRLEKQSRLCMVRPCEADLEENIKKGKKCIRTPKIAKPVKFELSGCTSVKTYRAKFCGVCTDGRCCTPHRTTTLPVEFKCPDGEIMKKNMMFIKTCACHYNCPGDNDIFESLYYRKMYGDMA

SEQ ID NO: 55 - protein, 349 aa, HOMO SAPIENS
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 56 - protein, 347 aa, RAT
MLASVAGPVSLALVLLLCTRPATGQDCSAQCQCAAEAAPRCPAGVSLVLDGCGCCRVCAKQLGELCTERDPCDPHKGLFCDFGSPANRKIGVCTAKDGAPCVFGGSVYRSGESFQSSCKYQCTCLDGAVGCVPLCSMDVRLPSPDCPFPRRVKLPGKCCEEWVCDEPKDRTVVGPALAAYRLEDTFGPDPTMMRANCLVQTTEWSACSKTCGMGISTRVTNDNTFCRLEKQSRLCMVRPCEADLEENIKKGKKCIRTPKIAKPVKFELSGCTSVKTYRAKFCGVCTDGRCCTPHRTTTLPVEFKCPDGEIMKKNMMFIKTCACHYNCPGDNDIFESLYYRKMYGDMA

SEQ ID NO: 57 - protein, 349 aa, BOVINE
MSATGLGPVRCAFVLLLALCSRPASSQDCCSAPCQCPAGPAPRCPAGVSLVLDGCGCCVCAKQLSELCTERDPCDPHKGLFCDFGSPTNRKIGVCTAKDGAPYIFGGTVYQSGESFQSSCKYQCTCLDGSVGCVPLCSVDVRLPSPDCPFPRRVKLPGKCCEEWVSRDEKEHTVVGPALAAYRLEDTFGPDPTMIRANCQVQTTEWSAYSKTCGMGISTRVTNDNAFCRLEKQSRLCMVRPCEADLEENIKKGKKCIRTPKISKPIKFQLSGCTSMKTYRAKFFGVCTDGRCCTPHRTTTLPVEFKCPDGEVMKKSMMFIKTCACHYNCPGDNDIFESLYYRKMYGDMA

SEQ ID NO: 58 - protein, 354 aa, MOUSE
MSLFLRKRCLCLGFLLFHLLSQVSASLRCPSRCPPKCPSISPTCAPGVRSVLDGCSCCPVCARQRGESCSEMRPCDQSSGLYCDRSADPNNQTGICMVPEGDNCVFDGVIYRNGEKFEPNCQYFCTCRDGQIGCLPRCQLDVLLPGPDCPAPRKVAVPGECCEKWTCGSDEQGTQGTLGGLALPAYRPEATVGVEVSDSSINCIEQTTEWSACSKSCGMGVSTRVTNRNRQCEMVKQTRLCIVRPCEQEPEEVTDKKGKKCLRTKKSLKAIHLQFENCTSLYTYKPRFCGVCSDGRCCTPHNTKTIQVEFQCLPGEIIKKPVMVIGTCTCYSNCPQNNEAFLQDLELKTSRGEI

SEQ ID NO: 59 - protein, 357 aa, HOMO SAPIENS
MQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 60 - protein, 379 aa, MOUSE
MSSSTFRTLAVAVTLLHLTRLALSTCPAACHCPLEAPKCAPGVGLVRDGCGCCKVCAKQLNEDCSKTQPCDHTKGLECNFGASSTALKGICRAQSEGRPCEYNSRIYQNGESFQPNCKHQCTCIDGAVGCIPLCPQELSLPNLGCPNPRLVKVSGQCCEEWVCDEDSIKDSLDDQDDLLGLDASEVELTRNNELIAIGKGSSLKRLPVFGTEPRVLFNPLHAHGQKCIVQTTSWSQCSKSCGTGISTRVTNDNPECRLVKETRICEVRPCGQPVYSSLKKGKKCSKTKKSPEPVRFTYAGCSSVKKYRPKYCGSCVDGRCCTPLQTRTVKMRFRCEDGEMFSKNVMMIQSCKCNYNCPHPNEASFRLYSLFNDIHKFRD

SEQ ID NO: 61 - protein, 381 aa, HOMO SAPIENS [sequence omitted]

SEQ ID NO: 62 - protein, 379 aa, RAT
MSSSTIKTLAVAVTLLHLTRLALSTCPASCHCPLEAPKCAPGVGLVRDGCGCCKVCAKQLNEDCSKTQPCDHTKGLECNFGANSTALKGICRAQSEGRPCEYNSRIYQNGESFQPNCKHQCTCIDGAVGCIPLCPQELSLPNLGCPNPRLVKVSGQCCEEWVCDEDSIKDSLDDQDDLLGFDASEVELTRNNELIATGKGSSLKRLPVFGTEPRVLYNPLHAHGQKCIVQTTSWSQCSKSCGTGISTRVTNDNPECRLVKETRICEVRPCGQPVYSSLKKGKKCSKTKKSPEPVRFTYAGCSSVKKYRPKYCGSCVDGRCCTPLQTRTVKMRFRCEDGEMFSKNVMMIQSCKCNYNCPHPNEASFRLYSLFNDIHKFRD

SEQ ID NO: 63 - protein, 375 aa, XENOPUS
MSFLALNPVLAIALLSGFIDLAVSSCPAVCQCPVEVPKCAPGVGLVLDGCGCCKICAKQLNEDCSKTHPCDHTKGLECNFGASSRAIKGICRAKSEGRPCEYNSKIYQNGESFQPNCKHQCTCIDGAVGCLPLCPQELSLPNLGCPNPRLVKVPGQCCEEWVCDEAKDPVDEMDDFFNKEFGMDTNEGELTRKNEFVAVIKGGLKMLPVFGSDPQSHVVENSKCIVQTTSWSQCSKTCGTGISTRVTNDNSNCRLVRETRICEVRPCGQPSYTSLKKGKKCTKTKKSQAPVRYTYAGCSSVKKYRPKYCGSCVDGRCCTPQQTRTVKIRFRCEDGETFTKNVMMIQSCRCNYNCPHTNEAYPYYRLFNDIHKFRD

SEQ ID NO: 64 - protein, 184 aa, MOUSE
MNRTAYTVGALLLLLGTLLPTAEGKKKGSQGAIPPPDKAQHNDSEQTQSPPQPGSRTRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 65 - protein, 184 aa, MOUSE; identical to SEQ ID NO: 64

SEQ ID NO: 66 - protein, 184 aa, HOMO SAPIENS
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 67 - protein, 4545 aa, MOUSE
MLTPPLLLLLPLLSALVSGATMDAPKTCSPKQFACRDQITCISKGWRCDGERDCPDGSDEAPEICPQSKAQRCPPNEHSCLGTELCVPMSRLCNGIQDCMDGSDEGAHCRELRANCSRMGCQHHCVPTPSGPTCYCNSSFQLQADGKTCKDFDECSVYGTCSQLCTNTDGSFTCGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANTQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVAGAPPTVTLLRSERPPIFEIRMYDAQQQQVGTNKCRVNNGGCSSLCLATPGSRQCACAEDQVLDTDGVTCLANPSYVPPPQCQPGEFACANNRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHSDEFQCRLDGLCIPLRWRCDGDTDCMDSSDEKSCEGVTHVCDPNVKFGCKDSARCISKAWVCDGDSDCEDNSDEENCEALACRPPSHPCANNTSVCLPPDKLCDGKDDCGDGSDEGELCDQCSLNNGGCSHNCSVAPGEGIVCSCPLGMELGSDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTIHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGRGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNHTLLFSGQKGPVGLAIDFPESKLYWISSGNHTINRCNLDGSELEVIDTMRSQLGKATALAIMGDKLWWADQVSEKMGTCNKADGSGSVVLRNSTTLVMHMKVYDESIQLEHEGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGHYPRIERSRLDGTERVVLVNVSISWPNGISVDYQGGKLYWCDARMDKIERIDLETGENREVVLSSNNMDMFSVSVFEDFIYWSDRTHANGSIKRGCKDNATDSVPLRTGIGVQLKDIKVFNRDRQKGTNVCAVANGGCQQLCLYRGGGQRACACAHGMLAEDGASCREYAGYLLYSERTILKSIHLSDERNLNAPVQPFEDPEHMKNVIALAFDYRAGTSPGTPNRIFFSDIHFGNIQQINDDGSGRTTIVENVGSVEGLAYHRGWDTLYWTSYTTSTITRHTVDQTRPGAFERETVITMSGDDHPRAFVLDECQNLMFWTNWNELHPSIMRAALSGANVLTLIEKDIRTPNGLAIDHRAEKLYFSDATLDKIERCEYDGSHRYVILKSEPVHPFGLAVYGEHIFWTDWVRRAVQRANKYVGSDMKLLRVDIPQQPMGIIAVANDTNSCELSPCRINNGGCQDLCLLTHQGHVNCSCRGGRILQEDFTCRAVNSSCRAQDEFECANGECISFSLTCDGVSHCKDKSDEKPSYCNSRRCKKTFRQCNNGRCVSNMLWCNGVDDCGDGSDEIPCNKTACGVGEFRCRDGSCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCENGEDETHCNKFCSEAQFECQNHRCISKQWLCDGSDDCGDGSDEAAHCEGKTCGPSSFSCPGTHVCVPERWLCDGDKDCTDGADESVTAGCLYNSTCDDREFMCQNRLCIPKHFVCDHDRDCADGSDESPECEYPTCGPNEFRCANGRCLSSRQWECDGENDCHDHSDEAPKNPHCTSPEHKCNASSQFLCSSGRCVAEALLCNGQDDCGDGSDERGCHVNECLSRKLSGCSQDCEDLKIGFKCRCRPGFRLKDDGRTCADLDECSTTFPCSQLCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSGRSIIVDTKITWPNGLTVDYVTERIYWADAREDYIEFASLDGSNRHVVLSQDIPHIFALTLFEDYVYWTDWETKSINRAHKTTGANKTLLISTLHRPMDLHVFHALRQPDVPNHPCKVNNGGCSNLCLLSPGGGHKCACPTNFYLGGDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFICPPNRPFRCKNDRVCLWIGRQCDGVDNCGDGTDEEDCEPPTAQNPHCKDKKEFLCRNQRCLSSSLRCNMFDDCGDGSDEEDCSIDPKLTSCATNASMCGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQTFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLINLTGGLSHASDVVLYHQHKQPEVTNPCDRKKCEWLCLLSPSGPVCTCPNGKRLDNGTCVPVPSPTPPPDAPRPGTCTLQCFNGGSCFLNARRQPKCRCQPRYTGDKCELDQCWEYCHNGGTCAASPSGMPTCRCPTGFTGPKCTAQVCAGYCSNNSTCTVNQGNQPQCRCLPGFLGDRCQYRQCSGFCENFGTCQMAADGSRQCRCTVYFEGPRCEVNKCSRCLQGACVVNKQTGDVTCNCTDGRVAPSCLTCIDHCSNGGSCTMNSKMMPECQCPPHMTGPRCEEQVVSQQQPGHMASILIPLLLLLLLLLVAGVVFWYKRRVRGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 68 - protein, 4544 aa, HOMO SAPIENS
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSPEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 69 - protein, 4599 aa, MOUSE
MSQLLLAILTLSGLLPNAEVLIVGANQDQHLCDPGEFLCHDHVTCVSQSWLCDGDPDCPDQSDESLDTCPEEVEIKCPLNHIACHGSSACVHLSKLCNGVVDCPDGFDEGGHCQELLPSCQQLNCQFKCAMVRNATRCYCEDGFEVAEDGRSCKDQDECSIYGICSQTCKNTYGSYACSCVEGYIMQSDNRSCKVKHEPTDKAPMLLISSLETIELFYINGSKMTTLSSANRNEIHTLDFIYSEEMICWIESRESSNQLKCGQITKAGRLTDQRIINSLQSFQNVEQMAFDWLTRNIYFVDHVSDRIFVCNFNGSVCVTLIESELHNPKAIAADPIAGKLFFTDYGNVPKIERCDLDGMNRTRIVYSKAEQPSALALDLVNRLVYWVDLYLDYVGVVDYQGKNRHTIVQGRQVKHLYGITVFEDYLYATSSDNFNIIRINRFNGTDIHSIIKMESARGIRTYQKRTQPTVRSHACEVDAYGMPGGCSHICLLSSSYKTRTCRCRTGFNMGSDGRSCKRPKNELFLFYGKGRPGIVRGMDLNTKIADECMIPIENLVNPRALDFHAEANYIYFADTTSFLIGRQKIDGTERETILKDDLDNVEGIAVDWIGNNLYWTNDGHRKTINVARLEKASQSRKTLLEGGMSHPRAIVVDPVNGWMYWTDWKEDKIDDSVGRIEKAWMDGVNRQVFVTSKMLWPNGLTLDFHTSTLYWCDAYYDHIEKVFLNGTHRKVVYSGKELNHPFGLSHHGNYVFWTDYMNGSIFQLDLMTNEVTLLRHERAPLFGLQIYDPRKQQGDNMCRINNGGCGTLCLAIPAGRVCACADNQLLDENGTTCTFNPEEIRFHICKPGEFRCKNKHCIQARWKCDGDDDCLDGSDEDSVTCFNHSCPDDQFKCQNNRCIPKRWLCDGANDCGSNEDESNQTCTARTCQADQFSCGNGRCIPTAWLCDREDDCGDQTDEVASCEFPTCEPLTQFICKSGRCISNKWHCDTDDDCGDRSDEVGCVHSCLDDQFRCSSGRCIPGHWACDGDNDCGDFSDETHINCTKEEARSPAGCIGNEFQCRPDGNCIPDLWRCDGEKDCEDGSDEKGCNGTIRLCDHKTKFSCRSTGRCINNAWVCDGDVDCEDQSDEEDCDSFLCGPPKYPCANDTSVCLQPEKLCNGRKDCPDGSDEGDLCDECSLNNGGCSNHCSVVPGRGIVCSCPEGHQLKKDNRTCEIVDYCASHLRCSQVCEQQKHMVKCSCYEGWALGTDGESCTSVDSFEAFIIFSIRHEIRRIDLHKGDYSLLVPGLRNTIALDFHFNQSLLYWTDVVEDRIYRGKLSESGGVSAIEVVVEHGLATPEGLTVDWIAGNIYWIDSNLDQIEVSKLDGSLRATLIAGAMEHPRAIALDPRYGILFWTDWDANFPRIESASMSGAGRKTIYKDMKTGAWPNGLTVDHFERRIVWTDARSDAIYSAFYDGTNMIEIIRGHEYLSHPFAVSLYGSEVYWTDWRTNTLAKANKWTGQNVSVIQKTSAQPFDLQIYHPSRQPQAPNPCAANEGRGPCSHLCLINHNRSAACACPHLMKLSSDKKTCYEMKKFLLYARRSEIRGVDIDNPYVNFITAFTVPDIDDVAVIDFDASEERLYWTDIKTQTITRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCNKRDGRNPSILRNKTSGVVHMKVYDKEAQQGSNSCQVNNGGCSQLCLPTSETTRTCMCTVGYYLQKNRMSCQGIESFLMYSVHEGIRGIPLEPRDKVDALMPISGAAFAVGIDFHAENDTIYWTDMGLNKISRAKRDQTWKEDVVTNGLGRVEGIAVDWIAGNIYWTDHGFNLIEVARLNGSFRYVIISQGLDQPRSIAVHPEKGFLFWTEWGQVPCIGKARLDGSEKVMIVSVGITWPNGISIDYEENKLYWCDARSDKIERIDLDTGANREVLLSGSNVDLFSVAVFGAYIYWSDRAHANGSVRRGHKNDATETVTMRTGLGVNLKEIKIFNRVREKGTNVCAKENGGCQQLCLYRGNSRRTCACAHGYLAGDGVTCLRHEGYLLYSGRTILKSIHLSDETNLNSPVRPYENPNYFKNIIALAFDYNQRREGTNRIFYSDAHFGNIQLIKDNWEDRQVIVENVGSVEGLAYHRAWDTLYWTSSSTSSITRHTVDQTRPGAIDREAVITMSEDDHPHVLALDECQNLMFWTNWNEQHPSIMRATLTGKNAHVVVSTDILTPNGLTIDHRAEKLYFSDGSLGKIERCEYDGSQRHVIVKSGPGTFLSLAVYDSYIFWSDWGRRAILRSNKYTGGETKILRSDIPHQPMGIIAVANDTNSCELSPCALLNGGCHDLCLLTPDGRVNCSCRGDRVLLANNRCVTKNSSCNIYSEFECGNGDCVDYVLTCDGIPHCKDKSDEKLLYCENRSCRSGFKPCYNRRCVPHGKLCDGTNDCGDSSDELDCKVSTCSTVEFRCADGTCIPRSARCNQNMDCSDASDEKGCNNTDCTHFYKLGVKSTGFIRCNSTSLCVLPSWICDGSNDCGDYSDELKCPVQNKHKCEENYFGCPSGRCILNTWVCDGQKDCEDGLDELHCDSSCSWNQFACSVKKCISKHWICDGEDDCGDSLDESDSICGAVTCAADMFSCQGSHACVPQHWLCDGERDCPDGSDELSSAGCAPNNTCDENAFMCHNKVCIPKQFVCDHDDDCGDGSDEFLQCGYRQCGPEEFRCADGRCLVNTLWQCDGDFDCPDSSDEAPINPRCRSAEHSCNSSFFMCKNGRCIPSDGLCDIRDDCGDGSDETNCHINECLSKKISGCSQDCQDLPVSYKCKCWPGFQLKDDGKTCVDIDECSSGFPCSQQCINTYGTYKCHCAEGYETQPDNPNGCRSLSDEEPFLILADQHEIRKISTDGSNYTLLKQGLNNVIALDFDYREEFIYWIDSSRPNGSRINRMCLNGSDIKVVHNTAVPNALAVDWIGKNLYWSDTEKRIIEVSKLNGLYPTVLVSKRLKFPRDLSLDPRAGNLYWIDCCEYPHIGRVGMDGTNQSVVIETKISRPMALTIDYVNHRLYWADENHIEFSNMDGSHRHKVPNQDIPGVIALTLFEDYIYWTDGKTKSLSRVHKTSGADRLSLINSWHAITDIQVYHSYRQPDVSKHLCTVNNGGCSHLCLLGPGKTHTCACPTNFYLAADNRTCLSNCTASQFRCKTDKCIPFWWKCDTVDDCGDGSDEPDDCPEFKCQPGRFQCGTGLCALPAFICDGENDCGDNSDELNCDTHVCLAGQFKCTKNKKCIPVNLRCNGQDDCGDEEDEKDCPENSCSPDYFQCKTTKHCISKLWVCDEDPDCADASDEANCDKKTCGPHEFQCKNNNCIPDHWRCDNQNDCSDNSDEDNCKPQTCTLKDFLCSNGDCVSSRFWCDGEFDCADGSDEKNCETSCSKDQFQCSNGQCLSAKWKCDGHEDCKYGEDEKNCEPAFPVCSSSEYMCASGGCLSASLKCNGEPDCVDGSDEMDCVIECKEDQFQCKNKAYCIPIRWLCDGIYDCVDGSDEETCGRGGSICRDDEFLCNNSLCKLHFWVCDGEDDCGDNSDEAPDMCVKFLCPPTRPYRCRNDRICLQLEKICNGINDCGDNSDEEHCSGKLSLKSKPCKKDEFTCSNRNCIPMELQCDSLDDCGDGSDEQGCLKTPIEHTCENNGNPCGDDAYCNQIKTSVFCRCKPGFQRNMKGRECADLNECLLFGICSHHCLNTRGSYKCVCDQNFQEKNNSCIAKGSEDQALYIANDTDILGFVYPFNYSGGHQQISHVEHNSRITGMDVHYQRNVIVWSTQFNPGGIFYKMIDAREKRQANSGLICPEFKRPRDIAVDWVAGNVYWTDHSRMHWFSYYTTHWTSLRYSINVGQLNGPNCTRLLTNMAGEPYAIAVNPKRGMMYWTVIGDHSHIEEAAMDGTLRRVLVQKNLQRPTGLTVDHFGERIYWADFELSIIGSVLYDGSSPVVSVSSKQGLLHPHRIDVFEDYIYGAGPKNGIFRVQKFGHGSVEVLALGVDKTKSILVSHRYKQLNLPNPCLDLSCDFLCLLNPSGATCICPEGKYMMNGTCHDDSLLDDSCKLTCENGGRCILNEKGDLRCHCWPSYSGGRCEVNHCSNYCQNGGTCIPSTLGRPTCICALGFTGPNCGKAVCEDSCHNGGSCVVTAGNQPYCHCQADYTGDRCQYYVCHHYCVNSESCTIGNDGSVECVCPTRYEGPKCEIDKCVRCHGGHCIINKDNEDIFCNCTNGKIASSCQLCDGYCYNGGTCQLDPETSIPVCVCSTNWSGTQCERPAPKSSKSEHISTRSIAIIVPLVLLVTLVTTLVIGLVVCKRKRRTKTIRRQPIINGGINVEIGNPSYNMYEVDHDHSDGGLLEPSFMIDPVKSRYIGGGSSAFKLPHTAPPIYLNSDLKGPLTFGPTNYSNPVYAKLYMDGQNCRNSLASVDERKELLPKKIEIGIRETVA

SEQ ID NO: 70 - protein, 4599 aa, MOUSE; identical to SEQ ID NO: 69

SEQ ID NO: 71 - protein, 4545 aa, MOUSE; identical to SEQ ID NO: 67

SEQ ID NO: 72 - protein, 196 aa, MOUSE
LSSLAKPSENGNGVTFRSGADVNMDIGVSPFGPETIIDRSMAMNEQFVMEVGKQPVIFENPMYAAKDSTSKVGLAVQGPSVSSQVTVPENVENQNYGRSIDPSEIVPEPKPASPGADETQGTKWNIFKRKPKQTTNFENPIYAEMDTEQKEAVAVAPPPSPSLPAKASKRSSTPGYTATEDTFKDTANLVKEDSDV

SEQ ID NO: 73 - protein, 2867 aa, HOMO SAPIENS
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCSHSHVQQQ

SEQ ID NO: 74 - protein, 4660 aa, RAT
MERGAAAAAWMLLLAIAACLEPVSSQECGSGNFRCDNGYCIPASWRCDGTRDCLDDTDEIGCPPRSCESGLFLCPAEGTCIPSSWVCDEDKDCSDGADEQQNCAGTTCSAQQMTCSNGQCIPSEYRCDHVSDCPDGSDERNCHYPTCDQLTCANGACYNTSQRCDQKVDCRDSSDEANCTTLCSQKEFECGSGECILRAYVCDHDNDCEDNSDERNCNYDTCGGHQFTCSNGQCINQNWVCDGDDDCQDSGDEDGCESNQSHHRCYPREWACPGSGRCISIDKVCDGVPDCPEGDDENNVTSGRTCGMGVCSVLNCEYQCHQTPFGGECFCPPGHIINSNDSRTCIDFDDCQIWGICDQKCENRQGRHQCLCEEGYILERGQHCKSSDSFSAASVIFSNGRDLLVGDLHGRNFRILAESKNRGMVMGVDFHYQKHRVFWTDPMQEKVFSTDINGLNTQEILNVSVDTPENLAVDWINNKLYLVETKVNRIDVVNLEGNQRVTLITENLGHPRGIALDPTVGYLFFSDWGSLSGQPKVERAFMDGSNRKDLVTTKVGWPAGITLDLVSKRVYWVDSRYDYIETVTYDGIQRKTVARGGSLVPHPFGISLFEEHVFFTDWTKMAVMKASKFTETNPQVYHQSSLRPHGVTVYHALRQPNATNPCGSNNGGCAQVCVLSHRTDNGGLGYRCKCEFGFELDDDEHRCVAVKNFLLFSSKTAVRGIPFTLSTQEDVMVPVTGSPSFFVGIDFDAQHSTVFYSDLSKDIIYKQKIDGTGKEVITANRLESVECLTFDWISRNLYWTDGGLKSVTVLRLADKSRRQIISNLNNPRSIVVHPTAGYMFLSDWFRPAKIMRAWSDGSHLMPIVNTSLGWPNGLAIDWSASRLYWVDAFFDKIEHSTLDGLDRKRLGHVDQMTHPFGLTVFKDNVFITDWRLGAIIRVRKSDGGDMTVIRRGISSVMHVKAYDADLQTGSNYCSQTTHANGDCSHFCFPVPNFQRVCGCPYGMKLQRDQMTCEGDPAREPPTQQCGSLSFPCNNGKCVPSFFRCDGVDDCHDNSDEHQCGVFNNTCSPSAFACVRGGQCIPGQWHCDRQNDCLDGSDEQNCPTHATSSTCPSTSFTCDNHVCIPKDWVCDTDNDCSDGSDEKNCQASGTCQPTQFRCPDHRCISPLYVCDGDKDCADGSDEAGCVLNCTSAQFKCADGSSCINSRYRCDGVYDCRDNSDEAGCPTRPPGMCHPDEFQCQGDGTCIPNTWECDGHPDCIHGSDEHTGCVPKTCSPTHFLCDNGNCIYKAWICDGDNDCRDMSDEKDCPTQPFHCPSTQWQCPGYSTCINLSALCDGVFDCPNGTDESPLCNQDSCSHFNGGCTHQCMQGPFGATCLCPLGYQLANDTKTCEDINECDIPGFCSQHCVNMRGSFRCACDPEYTLESDGRTCKVTGSENPLLVVASRDKIIVDNITAHTHNLYSLVQDVSFVVALDFDSVTGRVFWSDLLQGKTWSVFQNGTDKRVVHDSGLSVTEMIAVDWIGRNLYWTDYALETIEVSKIDGSHRTVLISKNVTKPRGLALDPRMGDNVMFWSDWGHHPRIERASMDGTMRTVIVQEKIYWPCGLSIDYPNRLIYFMDAYLDYIEFCDYDGHNRRQVIASDLVLHHPHALTLFEDFVYWTDRGTRQVMQANKWHGGNQSVVMYSVHQPLGITAIHPSRQPPSRNPCASASCSHLCLLSAQAPRHYSCACPSGWNLSDDSVNCVRGDQPFLMSVRDNIIFGISLDPEVKSNDAMVPISGIQHGYDVEFDDSEQFIYWVENPGEIHRVKTDGSNRTVFAPLSLLGSSLGLALDWVSRNIYYTTPASRSIEVLTLKGDTRYGKTLIANDGTPLGVGFPVGIAVDPARGKLYWSDHGTDSGVPAKIASANMDGTSLKILFTGNLQHLEVVTLDIQEQKLYWAVTSRGVIERGNVDGTERMILVHHLAHPWGLVVYGSFLYYSDEQYEVIERVDKSSGNNKVVLRDNVPYLRGLRVYHRRNAADSSNGCSNNPNACQQICLPVPGGMFSCACASGFKLSPDGRSCSPYNSFMVVSMLPAVRGFSLELSDHSEAMVPVAGQGRNVLHADVDVANGFIYWCDFSSSVRSSNGIRRIKPDGSNFTNVVTYGIGANGIRGVALDWAAGNLYFTNAFVYETLIEVLRINTTYRRVLLKVSVDMPRHIIVDPKHRYLFWADYGQKPKIERSFLDCTNRTVLVSEGIVTPRGLAMDHDTGYIYWVDDSLDLIARIHLDGGESQVVRYGSRYPTPYGITVFGESIIWVDRNLKKVFQASKQPGNTDPPVVIRDKINLLRDVTIFDEHAQPLSPAELNNNPCLQSNGGCSHFCFALPELPTPRCGCAFGTLGNDGKSCATSQEDFLIYSLNNSLRSLHFDPRDHSLPFQVISVAGTAIALDYDRRNNRIFFTQKLNSLRGQISYVSLYSGSSSPTVLLSNIGVTDGIAFDWINRRIYYSDFSNQTINSMAEDGSNRAVIARVSKPRAIVLDPCRGYMYWTDWGTNAKIERATLGGNFRVPIVNTSLVWPNGLALDLETDLLYWADASLQKIERSTLTGTNREVVVSTAFHSFGLTVYGQYIYWTDLYTRKIYRANKYDGSDLVAMTTRLPTQPSGISTVVKTQRQQCSNPCDQFNGGCSHICAPGPNGAECQCPHEGNWYLANDNKYCVVDTGTRCNQLQFTCLNGHCINQDWKCDNDNDCGDGSDELPTVCAFHTCRSTAFTCGNGRCVPYHYRCDYYNDCGDNSDEAGCLFRNCNSTTEFTCSNGRCIPLSYVCNGINNCHDNDTSDEKNCPPHTCPPDFTKCQTTNICVPRAFLCDGDNDCGDGSDENPIYCASHTCRSNEFQCLSPQRCIPSYWFCDGEADCADGSDEPDTCGHSVNTCRASQFQCDNGRCISGNWVCDGDNDCGDMSDEDQRHHCELQNCSSTQFTCVNSRPPNRRCIPQYWVCDGDADCSDALDELQNCTMRTCSAGEFSCANGRCVRQSFRCDRRNDCGDYSDERGCSYPPCHANQFTCQNGRCIPRFFVCDEDNDCGDGSDEQEHLCHTPEPTCPLHQFRCDNGHCIEMGRVCNHVDDCSDNSDEKGCGINECLDSSISRCDHNCTDTITSFYCSCLPGYKLMSDKRSCVDIDECKESPQLCSQKCENVVGSYICKCAPGYIREPDGKSCRQNSNIEPYLIFSNRYYIRNLTTDGSSYSLILQGLGNVVALDFDRVEKRLYWIDAEKQIIERMFLNKTNRETIINHRLRRAESLAVDWVSRKLYWLDAILDCLFVSDLEGRHRKMIAQHCVDANNTFCFEHPRGIVLHPQRGHVYWADWGVHAYIGRIGMDGTNKSVIISTKIEWPNAITIDYTNDLLYWADAHLGYIEFSDLEGHHRHTVYDGSLPHPFALTIFEDTVFWTDWNTRTVEKGNKYDGSGRVVLVNTTHKPFDIHVYHPYRQPIMSNPCGTNNGGCSHLCLIKAGGRGFTCACPDDFQTVQLRDRTLCMPMCSSTQFLCGNNEKCIPIWWKCDGQKDCSDGSDEPDLCPHRFCRLGQFQCRDGNCTSPQALCNARQDCADGSDEDRVLCEHHRCESNEWQCANKRCIPQSWQCDSVNDCLDNSDEDTSHCASRTCRPGQFKCNNGRCIPQSWKCDVDNDCGDYSDEPIDECTTAAYNCDNHTEFSCKTNYRCIPQWAVCNGFDDCRDNSDEQGCESVPCHPSGDFRCANHHCIPLRWKCDGTDDCGDNSDEENCVPRECSESEFRCADQQCIPSRWVCDQENDCGDNSDERDCEMKTCHPEHFQCTSGHCVPKALACDGRADCLDASDESACPTRFPNGTYCPAAMFECKNHVCIQSFWICDGENDCVDGSDEEIHLCFNIPCESPQRFRCDNSRCVYGHQLCNGVDDCGDGSDEKEEHCRKPTHKPCTDTEYKCSNGNCISQHYVCDNVNDCGDLSDETGCNLGDNRTCAENICEQNCTQLSSGGFICSCRPGFKPSTSDKNSCQDINECEEFGICPQSCRNSKGSYECFCVDGFKSMSTHYGERCAADGSPPLLLLPENVRIRKYNTSSEKFSEYLEEEEHIQTIDYDWDPEHIGLSVVYYTVLAQGSQFGAIKRAYIPNFESGSNNPIREVDLGLKYLMQPDGLAVDWVGRHIYWSDAKSQRIEVATLDGRYRKWLITTQLDQPAAIAVNPKLGLMFWTDQGKQPKIESAWMNGEHRSVLVSENLGWPNGLSIDYLNDDRVYWSDSKEDVIEAIKYDGTDRRLIINEAMKPFSLDIFEDKLYWVAKEKGEVWRQNKFGKENKEKVLVVNPWLTQVRIFHQLRYNQSVSNPCKQVCSHLCLLRPGGYSCACPQGSDFVTGSTVQCDAASELPVTMPPPCRCMHGGNCYFDENELPKCKCSSGYSGEYCEVGLSRGIPPGTTMAVLLTFVIVIIVGALVLVGLFHYRKTGSLLPTLPKLPSLSSLAKPSENGNGVTFRSGADVNMDIGVSPFGPETIIDRSMAMNEHFVMEVGKQPVIFENPMYAAKDNTSKVALAVQGPSTGAQVTVPENVENQNYGRPIDPSEIVPEPKPASPGADEIQGKKWNIFKRKPKQTTNFENPIYAEMDSEVKDAVAVAPPPSPSLPAKASKRNLTPGYTATEDTFKDTANLVKEDSDV

SEQ ID NO: 75 - protein, 1614 aa, MOUSE
METAPTRAPPPPPPPLLLLVLYCSLVPAAASPLLLFANRRDVRLVDAGGVKLESTIVASGLEDAAAVDFQFSKGAVYWTDVSEEAIKQTYLNQTGAAAQNIVISGLVSPDGLACDWVGKKLYWTDSETNRIEVANLNGTSRKVLFWQDLDQPRAIALDPAHGYMYWTDWGEAPRIERAGMDGSTRKIIVDSDIYWPNGLTIDLEEQKLYWADAKLSFIHHANLDGSFRQKVVEGSLTHPFALTLSGDTLYWTDWQTRSIHACNKWTGEQRKEILSALYSPMDIQVLSQERQPPFHTPCEEDNGGCSHLCLLSPREPFYSCACPTGVQLQDNGKTCKTGAEEVLLLARRTDLRRISLDTPDFTDIVLQVGDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIVLHPVMGLMYWTDWGENPKIECANLDGRDRHVLVNTSLGWPNGLALDLQEGKLYWGDAKTDKIEVINIDGTKRKTLLEDKLPHIFGFTLLGDFIYWTDWQRRSIERVHKVKASRDVIIDQLPDLMGLKAVNVAKVVGTNPCADGNGGCSHLCFFTPRATKCGCPIGLELLSDMKTCIIPEAFLVFTSRATIHRISLETNNNDVAIPLTGVKEASALDFDVSNNHIYWTDVSLKTISRAFMNGSSVEHVIEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERMVIADDLPYPFGLTQYSDYIYWTDWNLHSIERADKTSGRNRTLIQGHLDFVMDILVFHSSRQDGLNDCVHSNGQCGQLCLAIPGGHRCGCASHYTLDPSSRNCSPPSTFLLFSQKFAISRMIPDDQLSPDLVLPLHGLRNVKAINYDPLDKFIYWVDGRQNIKRAKDDGTQPSMLTSPSQSLSPDRQPHDLSIDIYSRTLFWTCEATNTINVHRLDGDAMGVVLRGDRDKPRAIAVNAERGYMYFTNMQDHAAKIERASLDGTEREVLFTTGLIRPVALVVDNALGKLFWVDADLKRIESCDLSGANRLTLEDANIVQPVGLTVLGRHLYWIDRQQQMIERVEKTTGDKRTRVQGRVTHLTGIHAVEEVSLEEFSAHPCARDNGGCSHICIAKGDGTPRCSCPVHLVLLQNLLTCGEPPTCSPDQFACTTGEIDCIPGAWRCDGFPECADQSDEEGCPVCSASQFPCARGQCVDLRLRCDGEADCQDRSDEANCDAVCLPNQFRCTSGQCVLIKQQCDSFPDCADGSDELMCEINKPPSDDIPAHSSAIGPVIGIILSLFVMGGVYFVCQRVMCQRYTGASGPFPHEYVGGAPHVPLNFIAPGGSQHGPFPGIPCSKSVMSSMSLVGGRGSVPLYDRNHVTGASSSSSSSTKATLYPPILNPPPSPATDPSLYNVDVFYSSGIPATARPYRPYVIRGMAPPTTPCSTDVCDSDYSISRWKSSKYYLDLNSDSDPYPPPPTPHSQYLSAEDSCPPSPGTERSYCHLFPPPPSPCTDSS

SEQ ID NO: 76 - protein, 770 aa, HOMO SAPIENS
MEKRAAAGLEGAPGARAQLAVVCLVNIFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLVDGPAPADAPREPCSAQDPHPQVSTASSTLGPHSPEPLGVCRNPPPPCSPMLEASDDEALLVC

SEQ ID NO: 77 - protein, 770 aa, RAT
MEKRAAAGPEGAPGARAPLAVVCLVNLFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQTDEFRCDNGKCLPGPWQCNMVDECGDGSDEGNCSAPASEPPGSLCPGGTFPCSGARSTRCLPVERRCDGTQDCGDGSDEAGCPDLACGRRLGSFYGSFASPDLFGAARGPSDLHCTWLVDTQDPRRVLLQLELRLGYDDYVQVYEGLGERGDRLLQTLSYRSNHRPVSLEAAQGRLTVAYHARARSAGHGFNATYQVKGYCLPWEQPCGSSSEGDDGSTGEQGCFSEPQRCDGWWHCASGRDEQGCPACPPDQYPCEGGSGLCYAPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARTSQTVLGDGLLQAAPGPVPDPPVPNTDTGSPREAGDGPPSGSGHAPEVGPSVPPPPLNLRDPEYRPEDKERKACVDPLEDSPAPVDTPPEPCLAQDPHPQTPTASGIQDPHSAEPLGVCRSPPPTCSPILEASDDEALLVC

SEQ ID NO: 78 - protein, 1113 aa, MOUSE
MGRVSFSVRVSSVRRARCSCPGRCYLSCRVPPTTALRALNGLGCAGVPGETAGGAVGPGPLGTRGFLSGSKFQAPGSWKDCFGAPPAPDVLRADRSVGEGCPQKLVTANLLRFLLLVLIPCICALIVLLAILLSFVGTLKRVYFKSNDSEPLVTDGEARVPGVIPVNTVYYENTGAPSLPPSQSTPAWTPRAPSPEDQSHRNTSTCMNITHSQCQILPYHSTLAPLLPIVKNMDMEKFLKFFTYLHRLSCYQHILLFGCSLAFPECVVDGDDRHGLLPCRSFCEAAKEGCESVLGMVNSSWPDSLRCSQFRDHTETNSSVRKSCFSLQQEHGKQSLCGGGESFLCTSGLCVPKKLQCNGYNDCDDWSDEAHCNCSKDLFHCGTGKCLHYSLLCDGYDDCGDPSDEQNCDCNLTKEHRCGDGRCIAAEWVCDGDHDCVDKSDEVNCSCHSQGLVECTSGQCIPSTFQCDGDEDCKDGSDEENCSDSQTPCPEGEQGCFGSSCVESCAGSSLCDSDSSLSNCSQCEPITLELCMNLLYNHTHYPNYLGHRTQKEASISWESSLFPALVQTNCYKYLMFFACTILVPKCDVNTGQRIPPCRLLCEHSKERCESVLGIVGLQWPEDTDCNQFPEESSDNQTCLLPNEDVEECSPSHFKCRSGRCVLGSRRCDGQADCDDDSDEENCGCKERALWECPFNKQCLKHTLICDGFPDCPDSMDEKNCSFCQDNELECANHECVPRDLWCDGWVDCSDSSDEWGCVTLSKNGNSSSLLTVHKSAKEHHVCADGWRETLSQLACKQMGLGEPSVTKLIPGQEGQQWLRLYPNWENLNGSTLQELLVYRHSCPSRSEISLLCSKQDCGRRPAARMNKRILGGRTSRPGRWPWQCSLQSEPSGHICGCVLIAKKWVLTVAHCFEGREDADVWKVVFGINNLDHPSGFMQTRFVKTILLHPRYSRAVVDYDISVVELSDDINETSYVRPVCLPSPEEYLEPDTYCYITGWGHMGNKMPFKLQEGEVRIIPLEQCQSYFDMKTITNRMICAGYESGTVDSCMGDSGGPLVCERPGGQWTLFGLTSWGSVCFSKVLGPGVYSNVSYFVGWIERQIYIQTFLQKKSQG

SEQ ID NO: 79 - protein, 859 aa, HOMO SAPIENS
MNSFLIFARRIDIRMVSLDIPYFADVVVPINITMKNTIAIGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVSHVSHPFALTQQDRWIYWTDWQTKSIQRVDKYSGRNKETVLANVEGLMDIIVVSPQRQTGTNACGVNNGGCTHLCFARASDFVCACPDEPDSRPCSLVPGLVPPAPRATGMSEKSPVLPNTPPTTLYSSTTRTRTSLEEVEGRCSERDARLGLCARSNDAVPAAPGEGLHISYAIGGLLSILLILVVIAALMLYRHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTETEQLLQEEQSECSSVHTAATPERRGSLPDTGWKHERKLSSESQV

SEQ ID NO: 80 - protein, 1614 aa, MOUSE
METAPTRAPPPPPPPLLLLVLYCSLVPAAASPLLLFANRRDVRLVDAGGVKLESTIVASGLEDAAAVDFQFSKGAVYWTDVSEEAIKQTYLNQTGAAAQNIVISGLVSPDGLACDWVGKKLYWTDSETNRIEVANLNGTSRKVLFWQDLDQPRAIALDPAHGYMYWTDWGEAPRIERAGMDGSTRKIIVDSDIYWPNGLTIDLEEQKLYWADAKLSFIHRANLDGSFRQKVVEGSLTHPFALTLSGDTLYWTDWQTRSIHACNKWTGEQRKEILSALYSPMDIQVLSQERQPPFHTPCEEDNGGCSHLCLLSPREPFYSCACPTGVQLQDNGKTCKTGAEEVLLLARRTDLRRISLDTPDFTDIVLQVGDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIVLHPVMGLMYWTDWGENPKIECANLDGRDRHVLVNTSLGWPNGLALDLQEGKLYWGDAKTDKIEVINIDGTKRKTLLEDKLPHIFGFTLLGDFIYWTDWQRRSIERVHKVKASRDVIIDQLPDLMGLKAVNVAKVVGTNPCADGNGGCSHLCFFTPRATKCGCPIGLELLSDMKTCIIPEAFLVFTSRATIHRISLETNNNDVAIPLTGVKEASALDFDVSNNHIYWTDVSLKTISRAFMNGSSVEHVIEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERMVIADDLPYPFGLTQYSDYIYWTDWNLHSIERADKTSGRNRTLIQGHLDFVMDILVFHSSRQDGLNDCVHSNGQCGQLCLAIPGGHRCGCASHYTLDPSSRNCSPPSTFLLFSQKFAISRMIPDDQLSPDLVLPLHGLRNVKAINYDPLDKFIYWVDGRQNIKRAKDDGTQPSMLTSPSQSLSPDRQPHDLSIDIYSRTLFWTCEATNTINVHRLDGDAMGVVLRGDRDKPRAIAVNAERGYMYFTNMQDHAAKIERASLDGTEREVLFTTGLIRPVALVVDNALGKLFWVDADLKRIESCDLSGANRLTLEDANIVQPVGLTVLGRHLYWIDRQQQMIERVEKTTGDKRTRVQGRVTHLTGIHAVEEVSLEEFSAHPCARDNGGCSHICIAKGDGTPRCSCPVHLVLLQNLLTCGEPPTCSPDQFACTTGEIDCIPGAWRCDGFPECADQSDEEGCPVCSASQFPCARGQCVDLRLRCDGEADCQDRSDEANCDAVCLPNQFRCTSGQCVLIKQQCDSFPDCADGSDELMCEINKPPSDDIPAHSSAIGPVIGIILSLFVMGGVYFVCQRVMCQRYTGASGPFPHEYVGGAPHVPLNFIAPGGSQHGPFPGIPCSKSVMSSMSLVGGRGSVPLYDRNHVTGASSSSSSSTKATLYPPILNPPPSPATDPSLYNVDVFYSSGIPATARPYRPYVIRGMAPPTTPCSTDVCDSDYSISRWKSSKYYLDLNSDSDPYPPPPTPHSQYLSAEDSCPPSPGTERSYCHLFPPPPSPCTDSS

SEQ ID NO: 81 - protein, 1611 aa, HOMO SAPIENS
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 82 - protein, 1615 aa, HOMO SAPIENS
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATVRPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 83 - protein, 1613 aa, MOUSE
MGAVLRSLLACSFCVLLRAAPLLLYANRRDLRLVDATNGKENATIVVGGLEDAAAVDFVFGHGLIYWSDVSEEAIKRTEFNKSESVQNVVVSGLLSPDGLACDWLGEKLYWTDSETNRIEVSNLDGSLRKVLFWQELDQPRAIALDPSSGFMYWTDWGEVPKIERAGMDGSSRFVIINTEIYWPNGLTLDYQERKLYWADAKLNFIHKSNLDGTNRQAVVKGSLPHPFALTLFEDTLYWTDWNTHSILACNKYTGEGLREIHSNIFSPMDIHAFSQQRQPNATNPCGIDNGGCSHLCLMSPVKPFYQCACPTGVKLMENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGTIYWGDAKTDKIEVMNTDGTGRRVLVEDKIPHIFGFTLLGDYVYWTDWQRRSIERVHKRSAEREVIIDQLPDLMGLKATSVHRVIGSNPCAEDNGGCSHLCLYRPQGLRCACPIGFELIGDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSDMLGLNREVIADDLPHPFGLTQYQDYIYWTDWSRRSIERANKTSGQNRTIIQGHLDYVMDILVFHSSRQAGWNECASSNGHCSHLCLAVPVGGFVCGCPAHYSLNADNRTCSAPSTFLLFSQKSAINRMVIDEQQSPDIILPIHSLRNVRAIDYDPLDKQLYWIDSRQNSIRKAHEDGGQGFNVVANSVANQNLEIQPYDLSIDIYSRYIYWTCEATNVIDVTRLDGRSVGVVLKGEQDRPRAIVVNPEKGYMYFTNLQERSPKIERAALDGTEREVLFFSGLSKPIALALDSKLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGDIDCIPVAWRCDGFTECEDHSDELNCPVCSESQFQCASGQCIDGALRCNGDANCQDKSDEKNCEVLCLIDQFRCANGQCVGKHKKCDHSVDCSDRSDELDCYPTEEPAPQATNTVGSVIGVIVTIFVSGTIYFICQRMLCPRMKGDGETMTNDYVVHSPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDVNYDSEPVPPPPTPRSQYLSAEENYESCPPSPYTERSYSHHLYPPPPSPCTDSS

SEQ ID NO: 84 - protein, 1613 aa, HOMO SAPIENS
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAIVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 85 - protein, 996 aa, MOUSE
MGRPELGALRPLALLLLLLLQLQHLSAADPLLGGQGPVKECEEDQFRCRNERCIPLVWRCDEDNDCSDNSDEDDCPKRTCADSDFTCDNGHCIPERWKCDGEEECPDGSDESKATCSSEECPAEKLSCGPTSHKCVPASWRCDGEKDCEGGADEAGCPTLCAPHEFQCSNRSCLASVFVCDGDDDCGDGSDERGCSDPACPPREFRCGGGGTCIPERWVCDRQFDCEDRSDEAAELCGRAGQGTTATPAACAPTAQFTCRSGECIHLGWRCDGDRDCKDKSDEADCSPGPCRENEFQCGDGTCVLAIKRCNQERDCPDGSDEAGCLQESTCEGPRRFQCKSGECVDGGKVCDDQRDCRDWSDEPQKVCGLNECLHNNGGCSHICTDLKIGFECTCPAGFQLLDQKTCGDIDECQDPDACSQICVNYKGYFKCECHPGYEMDTLTKNCKAVAGKSPSLIFTNRHEVRRIDLVKRDYSRLIPMLKNVVALDVEVATNRIYWCDLSYRKIYSAHMDKASIPDEQVVLIDEQLHSPEGLAVDWVHKHIYWTDSGNKTISVATTDGRRRCTLFSRELSEPRAIAVDPLRGFMYWSDWGFQAKIEKAGLNGADRQTLVSDNIEWPNGITLDLLSQRLYWVDSKLHQLSSIDFNGGNRKMLIFSTDFLSHPFGVAVFEDKVFWTDLENEAIFSANRLNGLEIAILAENLNNPHDIVIFHELKQPKAADACDLSAQPNGGCEYLCLPAPQISSHSPKYTCACPDTMWLGPDMKRCYRAPQSTSTTTLASAMTRTVPATTRAPGTTIHDPTYQNHSTETPSQTAAAPHSVNVPRAPSTSPSTPSPATSNHSQHYGNEGSQMGSTVTAAVIGVIVPIVVIALLCMSGYLIWRNWKRKNTKSMNFDNPVYRKTTEEEEEDELHIGRTAQIGHVYPAAISNYDRPLWAEPCLGETRDLEDPAPALKELFVLPGEPRSQLHQLPKNPLSELPVVKCKRVALSLEDDGLP

SEQ ID NO: 86 - protein, 963 aa, HOMO SAPIENS
MGLPEPGPLRLLALLLLLLLLLLLRLQHLAAAAADPLLGGQGPAKECEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATVSQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAGGKSPSLIFTNRYEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 87 - protein, 713 aa, MOUSE
MLSALPLLFLLLGGALARPDRITFPRSACEAPPAVLSEVQGTLQRPLGRDSRSSPANCTWVILGSKDQTVTVRFQKLHLACGSEHLILHSPLQPPISLCEAPSGPLQLPGGNVTITYSYAGARAPMGQGFLLTYSQDWLLCLQEEFQCLNHRCIPAAQRCDGIDACGDGSDEAGCSSDPFPNLNPAPAPTLACNLTLEDFYGVFSSPGYSHLASVSHPQSCLWLLDPHDGRRLAVRFTALDLSYGDAVHVYDGAGPPETPRLLRSLTHFSNGKAVTVETLSGQAVVSYHTVAWSSGRGFNATYHVRGYCLPWDRPCGLGSGLGASENLGERCYSEAQRCDGSWDCADGTDEEGCPGCPPGHFPCGAAGTPGATACYLPADRCNYQTFCADGADERRCRHCQPGNFRCRDEKCVYETWVCDGQPDCTDGSDEWDCSYALPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGTSGGRRRQRGRSVRRLVRRLRRWGLLPRTNTPARAPETRSQVTPSVPSEALDDSTGHACEGGAVGGQDGEQAPPLPIKTPIPTPSTLPALATVSETPGPLPSVPVESSLLSGVVQVLRGRLLPSLWSPGPTWTQTGTHTTVLSPEDEDDVLLLPLAEPEVWVVEAEDEPLLA

SEQ ID NO: 88 - protein, 713 aa, MOUSE
MLSALPLLFLLLGGALARPDRITFPRSACEAPPAVLSEVQGTLQRPLGRDSRSSPANCTWVILGSKDQTVTVRFQKLHLACGSEHLILHSPLQPPISLCEAPSGPLQLPGGNVTITYSYAGARAPMGQGFLLTYSQDWLLCLQEEFQCLNHRCIPAAQRCDGIDACGDGSDEAGCSSDPFPNLNPAPAPTLACNLTLEDFYGVFSSPGYSHLASVSHPQSCLWLLDPHDGRRLAVRFTALDLSYGDAVHVYDGAGPPETPRLLRSLTHFSNGKAVTVETLSGQAVVSYHTVAWSSGRGFNATYHVRGYCLPWDRPCGLGSGLGASENLGERCYSEAQRCDGSWDCADGTDEEGCPGCPPGHFPCGAAGTPGATACYLPADRCNYQTFCADGADERRCRHCQPGNFRCRDEKCVYETWVCDGQPDCTDGSDEWDCSYALPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGTSGGRRRQRGRSIRRLVRRLRRWGLLPRTNTPARAPETRSQVTPSVPSEALDDSTGQACEGGAVGGQDGEQAPPLPIKTPIPTPSTLPALATVSEPPGPLPSVPVESSLLSGVVQVLRGRLLPSLWSPGPTWTQTGTHTTVLSPEDEDDVLLLPLAEPEVWVVEAEDEPLLA

SEQ ID NO: 89 - protein, 2214 aa, HOMO SAPIENS
MATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYECDFGFKMSEDLSLEVCVPDPEFSGKSYSPPVPCPVGSTYRRTRGYRKISGDTCSGGDVEARLEGELVPCPLAEENEFILYAVRKSIYRYDLASGATEQLPLTGLRAAVALDFDYEHNCLYWSDLALDVIQRLCLNGSTGQEVIINSGLETVEALAFEPLSQLLYWVDAGFKKIEVANPDGDFRLTIVNSSVLDRPRALVLVPQEGVMFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKEENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAIAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 90 - protein, 862 aa, MOUSE
MSTADLMRRWVIALLLAAAGVAAEDSCSRNEFQCRDGKCIASKWVCDGSPECPDGSDESPETCMSVTCQSNQFSCGGRVSRCIPDSWRCDGQVDCENDSDEQGCPPKTCSQDDFRCQDGKCISPQFVCDGDRDCLDGSDEAHCQATTCGPAHFRCNSSICIPSLWACDGDVDCVDGSDEWPQNCQGRDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTNECLDNNGGCSHICKDLKIGSECLCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNSGCQYLCLPAPQIGPHSPKFTCACPDGMLLAEDMRSCLTEVDTVLTTQGTSAVRPVVTASATRPPKHSEDLSAPSTPRQPVDTPGLSTVASVTVSHQVQGDMAGRGNEEQPHGVRFLSIFFPIALVALLVLGAVLLWRNWRLKNINSINFDNPVYQKTTEDELHICRSQDGYTYPSRQMVSLEDDVA

SEQ ID NO: 91 - protein, 862 aa, MOUSE
MSTADLMRRWVIALLLAAAGVAAEDSCSRNEFQCRDGKCIASKWVCDGSPECPDGSDESPETCMSVTCQSNQFSCGGRVSRCIPDSWRCDGQVDCENDSDEQGCPPKTCSQDDFRCQDGKCISPQFVCDGDRDCLDGSDEAHCQATTCGPAHFRCNSSICIPSLWACDGDVDCVDGSDEWPQNCQGRDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTNECLDNNGGCSHICKDLKIGSECLCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNGGCQYLCLPAPQIGPHSPKFTCACPDGMLLAKDMRSCLTEVDTVLTTQGTSAVRPVVTASATRPPKHSEDLSAPSTPRQPVDTPGLSTVASVTVSHQVQGDMAGRGNEEQPHGMRFLSIFFPIALVALLVLGAVLLWRNWRLKNINSINFDNPVYQKTTEDELHICRSQDGYTYPSRQMVSLEDDVA

SEQ ID NO: 92 - protein, 864 aa, MOUSE
MSTADLMRRWVIALLLAAAGVAVEDSGSRNEFQCRDGKCIASKWVCDGSPECPDGSDESPKTCMSVTCQSNQFSCGGRVSRCIPDSWRCDGQVDCENDSDEQGCPPKTCSQDDFRCQDGKCISPQFVCDGDRDCLDGSDEAHCPATTCGPAHFRCKSSICIPSLWACDGDVDCVDGSHEWPQNCQAEDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTNECLDNNGGCSHICKDLKIGSECLCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNGGCQYLCLPAPQIGPHSPKFTCACPDGMLLAKDMRSCLTEVDTVLTTQGTSAVRPVVTASATRPPKHSEDLSAPSTPRQPVDTPGLSTVASVTVSHQVQGDMAGRGNEEQPHGMRFLSIFFPIALVALLVLGAVLLWRNWRLKNITINSINFDNPVYQKTTEDELHICRSQDGYTYPSRQMVSLEDDVA

SEQ ID NO: 93 - protein, 873 aa, MOUSE
MGTSARWALWLLLALCWAPRDSGATASGKKAKCDSSQFQCTNGRCITLLWKCDGDEDCADGSDEKNCVKKTCAESDFVCKNGQCVPNRWQCDGDPDCEDGSDESPEQCHMRTCRINEISCGARSTQCIPVSWRCDGENDCDNGEDEENCGNITCSADEFTCSSGRCVSRNFVCNGQDDCDDGSDELDCAPPTCGAHEFQCSTSSCIPLSWVCDDDADCSDQSDESLEQCGRQPVIHTKCPTSEIQCGSGECIHKKWRCDGDPDCKDGSDEVNCPSRTCRPDQFECEDGSCIHGSRQSNGIRDCVDGSDEVNCKNVNQCLGPGKFKCRSGECIDMSKVCDQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHFKMIDNVYNPAAIAVDWVYKTIYWTDAASKTISVATLDGAKRKFLFNSDLREPASIAVDPLSGFVYWSDWGEPAKIEKAGMNGFDRRPLVTEDIQWPNGITLDLVKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEDDMENGGCEYLCLPAPQINDHSPKYTCSCPNGYNLEENGRECQSTSTPVTYSETKDINTTDILRTSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 94 - protein, 1614 aa, MOUSE
METAPTRAPPPPPPPLLLLVLYCSLVPAAASPLLLFANRRDVRLVDAGGVKLESTIVASGLEDAAAVDFQFSKGAVYWTDVSEEAIKQTYLNQTGAAAQNIVISGLVSPDGLACDWVGKKLYWTDSETNRIEVANLNGTSRKVLFWQDLDQPRAIALDPAHGYMYWTDWGEAPRIERAGMDGSTRKIIVDSDIYWPNGLTIDLEEQKLYWADAKLSFIHRANLDGSFRQKVVEGSLTHPFALTLSGDTLYWTDWQTRSIHACNKWTGEQRKEILSALYSPMDIQVLSQERQPPFHTPCEEDNGGCSHLCLLSPREPFYSCACPTGVQLQDNGKTCKTGAEEVLLLARRTDLRRISLDTPDFTDIVLQVGDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIVLHPVMGLMYWTDWGENPKIECANLDGRDRHVLVNTSLGWPNGLALDLQEGKLYWGDAKTDKIEVINIDGTKRKTLLEDKLPHIFGFTLLGDFIYWTDWQRRSIERVHKVKASRDVIIDQLPDLMGLKAVNVAKVVGTNPCADGNGGCSHLCFFTPRATKCGCPIGLELLSDMKTCIIPEAFLVFTSRATIHRISLETNNNDVAIPLTGVKEASALDFDVSNNHIYWTDVSLKTISRAFMNGSSVEHVIEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERMVIADDLPYPFGLTQYSDYIYWTDWNLHSIERADKTSGRNRTLIQGHLDFVMDILVFHSSRQDGLNDCVHSNGQCGQLCLAIPGGHRCGCASHYTLDPSSRNCSPPSTFLLFSQKFAISRMIPDDQLSPDLVLPLHGLRNVKAINYDPLDKFIYWVDGRQNIKRAKDDGTQPSMLTSPSQSLSPDRQPHDLSIDIYSRTLFWTCEATNTINVHRLDGDAMGVVLRGDRDKPRAIAVNAERGYMYFTNMQDHAAKIERASLDGTEREVLFTTGLIRPVALVVDNALGKLFWVDADLKRIESCDLSGANRLTLEDANIVQPVGLTVLGRHLYWIDRQQQMIERVEKTTGDKRTRVQGRVTHLTGIHAVEEVSLEEFSAHPCARDNGGCSHICIAKGDGTPRCSCPVHLVLLQNLLTCGEPPTCSPDQFACTTGEIDCIPGAWRCDGFPECADQSDEEGCPVCSASQFPCARGQCVDLRLRCDGEADCQDRSDEANCDAVCLPNQFRCTSGQCVLIKQQCDSFPDCADGSDELMCEINKPPSDDIPAHSSAIGPVIGIILSLFVMGGVYFVCQRVMCQRYTGASGPFPHEYVGGAPHVPLNFIAPGGSQHGPFPGIPCSKSVMSSMSLVGGRGSVPLYDRNHVTGASSSSSSSTKATLYPPILNPPPSPATDPSLYNVDVFYSSGSPATARPYRPYVIRGMAPPTTPCSTDVCDSDYSTSRWKSSKYYLDLNSDSDPYPPPPTPHSQYLSAEDSCPPSPGTERSYCHLFPPPPSPCTDSS

SEQ ID NO: 95 - protein, 837 aa, HOMO SAPIENS
GDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPASQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 96 - DNA, 1696 bp, MOUSE
acagtccacagtgcagaagcaagggggaaagaattagcggctcctcagcccagcaaatcctccactcatcatgcttcctcctgccattcatctctctctcattcccctgctctgcatcctgatgagaaactgtttggcttttaaaaatgatgccacagaaatcctttattcacatgtggttaaacctgtcccggcacaccccagcagcaacagcaccctgaatcaagccaggaatggaggcaggcatttcagtagcactggactggatcgaaacagtcgagttcaagtgggctgcagggaactgcggtccaccaaatacatttcggacggccagtgcaccagcatcagccctctgaaggagctggtgtgcgcgggcgagtgcttgcccctgccggtgcttcccaactggatcggaggaggctatggaacaaagtactggagccggaggagctctcaggagtggcggtgtgtcaacgacaagacgcgcacccagaggatccagctgcagtgtcaggacggcagcacgcgcacctacaaaatcaccgtggtcacggcgtgcaagtgcaagaggtacacccgtcagcacaacgagtccagccacaactttgaaagcgtgtcgcccgccaagcccgcccagcaccacagagagcggaagagagccagcaaatccagcaagcacagtctgagctagacctggactgactagaaagcatctgctacccagatttgattgcttggaagactctctctcgagcctgccattgctctttcctcacttgaaagtatatgctttctgctttgatcaagcccagcaggctgtccttctctgggactagcttttcctttgcaagtgtctcaagatgtaatgagtagtttgcagtgaaagccaggcatcctgtagtttccatcccctcccccatcccagtcatttctttaaaagcacctgatgctgcattctgttacagtttaaaaaaaaaaaaaaacaaaaaacgctcctttccctaaaccccttcccaaactaaatccctccgaaccagagaagttcgtggaaaaaaatgtatcttcccagaacatttcagaaaggggcttttccagtcgtttttatgggaatagtttgacagccaggggttagttttgaaagagaggcaaaccttgtgacatttcacttcaaaaaacagcccggtggcatttttccagtctcagtgtgaaattatccccctgaatgttgacctctctgggagtggaatgccagcaattcatggcagcagctaataggtaaagccggttatttatttgtcaatgttgttatttaatgagctcttgcatgtgattttttttcaaaatgttaattttttttatgttttgaagctttttcatgtacctaaatatttcccaatacgatttgtggttggtctagaaatatgaaaatatctgttgtagatatgtaaaataaatgttttactctccgtatatattgcacggttcaccatcatcattagcgtggttttctgtaaagctgaagtatgtaatactttattatttagtccatgaaatcagatggcagcttgatcttcaatgccattggtttcctttaataaacataaacactgctcaacgctgttgtccttgcctctaacatgtataaaaaggtacatgcttgcagacattgtaaaataaagttatacgctgtaatcgc

SEQ ID NO: 97 - DNA, 1568 bp, RAT
atgcttcctcctgccattcatctctctctcattcccctgctctgcatcctgatgaaaaactgtttggcttttaaaaatgatgccacagaaatcctttattcacatgtggttaaacctgtttcagcacaccccagcagcaacagcaccttgaatcaagccaggaatggaggcaggcacttcagtagcacgggactggatcgaaatagtcgagttcaagtgggctgcagggaactgcggtccaccaaatacatctcggatggccagtgcaccagcatcagccctctgaaggagctggtgtgcgcgggtgagtgcttgcccttgccagtgcttcccaactggatcggaggaggctacggaacaaagtactggagccggaggagctcccaggagtggcggtgtgtcaacgacaagacgcgcacccagagaatccagctgcagtgtcaggacggcagcacacgcacctacaaaatcaccgtggtcacagcgtgcaagtgcaagaggtacacccggcagcacaacgagtccagccacaactttgaaagcgtgtctcccgccaagcccgcccagcaccacagagagcggaagagagccagcaaatccagcaagcacagtctgagctagagctggactgactagaaagcatctgctccccagatttgattgcgtggaagactcgctcgagcctgccattgctcttttctcacttgaaagtatatgctttctgctttgatcaggcccagcaggctgtccttctctgggactagcttttcctttgcaagtttctcaagatgtaatgagtagtttgcagtgaaagccaggcatcccatagtttcaccccctcccccagtcatttctttcaaaagcacctgatgctgcatcctgttacagtttaaaccgcgctccattccctaacccttcccaaactaaatccctccgaaccggagaagttcaatcaaaaaaaaaatgtatcttcacagaacatttcacaaaggggcttttccagtagtttttatgggaatagtttgacagccaggggttagcttcctttgaaagagaggcaaaccttgtgacatttcacttcaaaaataagcccggtggcattttccagtctcagtgtgaaattatccccctcgtgttgacctctcttggagtggaatgccagcaatgcaaggcagcagctagtaggtaaagccggttatttatttgtcgatgttgttatttaatgagctcgcgcatgtgattttttttccaaatgttaattttttttatattttgaagctttttcatgtacctaaatatttcccaatacgatttgtggttggtctagaaatatgaaaatacatgttgtagatatgtaaaaataaatattttagactccttatatattacacggttcgtcattagcgtggttccctgtaaagctgaagttatgtaatactttattatttagtccatgaaatcagaaggcagcttgaccttcggtaccatcggtttcttttaataaacataaatgctgttgtctttgcctctgacatgcatgcttgcagatactgtaaaataaagttata

SEQ ID NO: 98 - DNA, 378 bp, DANIO RERIO
ggctgcagggagctgaggtccactaagtatatatctgatggccaatgcaccagcctgaacccagtcaaggagttggtgtgtgctggtgaatgtctgcccacccacctgctgcccaactggatcggtggaggtcactactggagcagacgggatgcccaggagtggcgctgtgtcaccgaccgcacacgtacccagcgcattaaactccagtgccaggacggcaccacacgcacatacaaaatcacagctgtcacctcctgcacatgcaagagatacactcgccaaaacaacgagtcctctcatgcacctcagagtcactcaaaggatcatccactgcagagccccaagaagaaaaaaagcaaaaataaaaactccaag

SEQ ID NO: 99 - DNA, 4845 bp, MOUSE
atggaaacggcgccgacccgggcccctccgccgccgccgccgccgctgctgctgctggtgctgtactgcagcttggtccccgccgcggcctcaccgctcctgttgtttgccaaccgccgggatgtgcggctagtggatgccggcggagtgaagctggagtccaccattgtggccagtggcctggaggatgcagctgctgtagacttccagttctccaagggtgctgtgtactggacagatgtgagcgaggaggccatcaaacagacctacctgaaccagactggagctgctgcacagaacattgtcatctcgggcctcgtgtcacctgatggcctggcctgtgactgggttggcaagaagctgtactggacggactccgagaccaaccgcattgaggttgccaacctcaatgggacgtcccgtaaggttctcttctggcaggacctggaccagccaagggccattgccctggatcctgcacatgggtacatgtactggactgactggggggaagcaccccggatcgagcgggcagggatggatggcagtacccggaagatcattgtagactccgacatttactggcccaatgggctgaccatcgacctggaggaacagaagctgtactgggccgatgccaagctcagcttcatccaccgtgccaacctggacggctccttccggcagaaggtggtggagggcagcctcactcacccttttgccctgacactctctggggacacactctactggacagactggcagacccgctccatccacgcctgcaacaagtggacaggggagcagaggaaggagatccttagtgctctgtactcacccatggacatccaagtgctgagccaggagcggcagcctcccttccacacaccatgcgaggaggacaacggtggctgttcccacctgtgcctgctgtccccgagggagcctttctactcctgtgcctgccccactggtgtgcagttgcaggacaatggcaagacgtgcaagacaggggctgaggaagtgctgctgctggctcggaggacagacctgaggaggatctctctggacacccctgacttcacagacatagtgctgcaggtgggcgacatccggcatgccattgccattgactacgatcccctggagggctacgtgtactggaccgatgatgaggtgcgggctatccgcagggcgtacctagatggctcaggtgcgcagacacttgtgaacactgagatcaatgaccccgatggcattgctgtggactgggtcgcccggaacctctactggacagatacaggcactgacagaattgaggtgactcgcctcaacggcacctcccgaaagatcctggtatctgaggacctggacgaaccgcgagccattgtgttgcaccctgtgatgggcctcatgtactggacagactggggggagaaccccaaaatcgaatgcgccaacctagatgggagagatcggcatgtcctggtgaacacctcccttgggtggcccaatggactggccctggacctgcaggagggcaagctgtactggggggatgccaaaactgataaaatcgaggtgatcaacatagacgggacaaagcggaagaccctgcttgaggacaagctcccacacatttttgggttcacactgctgggggacttcatctactggaccgactggcagagacgcagtattgaaagggtccacaaggtcaaggccagccgggatgtcatcattgatcaactccccgacctgatgggactcaaagccgtgaatgtggccaaggttgtcggaaccaacccatgtgcggatggaaatggagggtgcagccatctgtgcttcttcaccccacgtgccaccaagtgtggctgccccattggcctggagctgttgagtgacatgaagacctgcataatccccgaggccttcctggtattcaccagcagagccaccatccacaggatctccctggagactaacaacaacgatgtggctatcccactcacgggtgtcaaagaggcctctgcactggactttgatgtgtccaacaatcacatctactggactgatgttagcctcaagacgatcagccgagccttcatgaatgggagctcagtggagcacgtgattgagtttggcctcgactaccctgaaggaatggctgtggactggatgggcaagaacctctattgggcggacacagggaccaacaggattgaggtggcccggctggatgggcagttccggcaggtgcttgtgtggagagaccttgacaaccccaggtctctggctctggatcctactaaaggctacatctactggactgagtggggtggcaagccaaggattgtgcgggccttcatggatgggaccaattgtatgacactggtagacaaggtgggccgggccaacgacctcaccattgattatgccgaccagcgactgtactggactgacctggacaccaacatgattgagtcttccaacatgctgggtcaggagcgcatggtgatagctgacgatctgccctacccgtttggcctgactcaatatagcgattacatctactggactgactggaacctgcatagcattgaacgggcggacaagaccagtgggcggaaccgcaccctcatccagggtcacctggacttcgtcatggacatcctggtgttccactcctcccgtcaggatggcctcaacgactgcgtgcacagcaatggccagtgtgggcagctgtgcctcgccatccccggaggccaccgctgtggctgtgcttcacactacacgctggaccccagcagccgcaactgcagcccgccctccaccttcttgctgttcagccagaaatttgccatcagccggatgatccccgatgaccagctcagcccggaccttgtcctaccccttcatgggctgaggaacgtcaaagccatcaactatgacccgctggacaagttcatctactgggtggacgggcgccagaacatcaagagggccaaggacgacggtacccagccctccatgctgacctctcccagccaaagcctgagcccagacagacagccacacgacctcagcattgacatctacagccggacactgttctggacctgtgaggccaccaacactatcaatgtccaccggctggatggggatgccatgggagtggtgcttcgaggggaccgtgacaagccaagggccattgctgtcaatgctgagcgagggtacatgtactttaccaacatgcaggaccatgctgccaagatcgagcgagcctccctggatggcacagagcgggaggtcctcttcaccacaggcctcatccgtcccgtggcccttgtggtggacaatgctctgggcaagctcttctgggtggatgccgacctaaagcgaatcgaaagctgtgacctctctggggccaaccgcctgaccctggaagatgccaacatcgtacagccagtaggtctgacagtgctgggcaggcacctctactggatcgaccgccagcagcagatgatcgagcgcgtggagaagaccactggggacaagcggactagggttcagggccgtgtcacccacctgacaggcatccatgccgtggaggaagtcagcctggaggagttctcagcccatccttgtgcccgagacaatggcggctgctcccacatctgtatcgccaagggtgatggaacaccgcgctgctcgtgccctgtccacctggtgctcctgcagaacctgctgacttgtggtgagcctcctacctgctcccctgatcagtttgcatgtaccactggtgagatcgactgcatccccggagcctggcgctgtgacggcttccctgagtgtgctgaccagagtgatgaagaaggctgcccagtgtgctccgcctctcagttcccctgcgctcgaggccagtgtgtggacctgcggttacgctgcgacggtgaggccgactgccaggatcgctctgatgaagctaactgcgatgctgtctgtctgcccaatcagttccggtgcaccagcggccagtgtgtcctcatcaagcaacagtgtgactccttccccgactgtgctgatgggtctgatgagctcatgtgtgaaatcaacaagccaccctctgatgacatcccagcccacagcagtgccattgggcccgtcattggtatcatcctctccctcttcgtcatgggcggggtctactttgtctgccagcgtgtgatgtgccagcgctacacaggggccagtgggccctttccccacgagtatgttggtggagcccctcatgtgcctctcaacttcatagccccaggtggctcacagcacggtcccttcccaggcatcccgtgcagcaagtccgtgatgagctccatgagcctggtgggggggcgcggcagcgtgcccctctatgaccggaatcacgtcactggggcctcatccagcagctcgtccagcacaaaggccacactatatccgccgatcctgaacccacccccgtccccggccacagacccctctctctacaacgtggacgtgttttattcttcaggcatcccggccaccgctagaccatacaggccctacgtcattcgaggtatggcacccccaacaacaccgtgcagcacagatgtgtgtgacagtgactacagcatcagtcgctggaagagcagcaaatactacctggacttgaattcggactcagacccctacccccccccgcccaccccccacagccagtacctatctgcagaggacagctgcccaccctcaccaggcactgagaggagttactgccacctcttcccgcccccaccgtccccctgcacggactcgtcctga

SEQ ID NO: 100 - DNA, 4848 bp, HOMO SAPIENS
atggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggactttaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtagacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgtgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctga

SEQ ID NO: 101 - DNA, 642 bp, MONKEY
atgcagctcccactggccctgtgtcttgtctgcctgctggtacacgcagccttccgtgtagtggagggccaggggtggcaggccttcaagaatgatgccacggaaatcatccccgagctcggagagtaccccgagcctccaccggagctggagaacaacaagaccatgaaccgggcggagaatggagggcggcctccccaccacccctttgagaccaaagacgtgtccgagtacagctgccgagagctgcacttcacccgctacgtgaccgatgggccgtgccgcagcgccaagccagtcaccgagttggtgtgctccggccagtgcggcccggcacgcctgctgcccaacgccatcggccgcggcaagtggtggcgcccgagtgggcccgacttccgctgcatccccgaccgctaccgcgcgcagcgtgtgcagctgctgtgtcccggtggtgccgcgccgcgcgcgcgcaaggtgcgcctggtggcctcgtgcaagtgcaagcgcctcacccgcttccacaaccagtcggagctcaaggacttcggtcccgaggccgctcggccgcagaagggccggaagccgcggccccgcgcccggggggccaaagccaatcaggccgagctggagaacgcctactag

SEQ ID NO: 102 - DNA, 264 bp, DANIO RERIO
gtggtcagtcccgttcaggatgcgcagagcaacgcgtctctgaaccgcgcgcgctccggaggaagaggcttcagcacgcacgacagagaacgaatcccagtaggctgcagagagctccgatccaccaagtacatctcagatggccagtgcaccagcataaaccctgtgaaagagctggtgtgcacaggacagtgcctccccgctcagatgctgcccaattggattggaggatacggcaagaagtcctggaaccgtcttgctttt

SEQ ID NO: 103 - DNA, 5037 bp, DROSOPHILA
atggctctcgagccatacacaaagtctgctgaaatcgaacctcaattgtgccaagttatagataataatgaagatgtgacaacgaaagcgacgaaatgcacgaaatctaacagcggagtgggctggcgacaaatgctgatcggctttctactgatttgctttggcatctcaaacagttggcagtacaaaaatgttcacatgcccagctcctcatccctgatcgccagcccgccagccagtgcgtttgtcaatacgccggccaccctgctctttaccacgcgccacgacatccaggtggcgaacatcacgaggccaacgggcggacctcagatcgatgtgatcgttagggatctggccgaggcgatggccatcgatttctactacgctaagaatctggtctgctggacggattccggacgggagatcattgagtgtgcgcaaacgaactcatccgcactgcagccgctattgcgggcgcccaagcaaactgtgatatccacgggtctggacaagcccgagggcctggccatggactggtatacggacaagatctactggacggatggcgaaaagaatcgcattgaggtggccacgctggatggtcgctaccagaaggtgctgttctggacagatctggatcagccgcgagcggtggccgtggttcctgctcgaaaattgctcatctggacggattggggggagtatccgaagattgagcgagccagcatggacggagatccattgtcacgcatgacattggtcaaggagcatgtgttctggcccaacggattggcagtagacctaaagaacgagctcatctactggacagatggcaagcaccatttcatcgatgtgatgagactagatggaagcagtcggcgaacgatagtcaacaacctgaagtatccatttagtttgaccttctacgatgatcgtttgtactggacggattggcagaggggctccctgaacgctttggatctgcaaacccgtgaactaaaggagctaatagacacgcccaaggcaccgaactctgtcagagcatgggatccctcactccagccttatgaggataatccctgtgctcacaacaatggaaattgctcacatctctgcctgctggcgacaaactcgcaaggatttagttgcgcctgtcccactggagtgaagctaatctctgcaaatacgtgtgccaatggttcgcaggagatgatgttcattgtgcagcgaacgcagattagtaagatatccctggactcaccggattacactatattcccgctgcctttggggaaggttaagtacgcaatagccatagattacgatccagtggaggagcatatctattggtccgatgtggagacgtacacgatcaagagagctcatgccgatggcaccggtgtgactgactttgtgacctcggaggtcaggcatcccgatggtttggcattggattggctggctcgcaatctctactggacggatacggtgasggatcgaatagaggtctgccgcctggatggtacggcaagaaaagtgctgatctatgagcatttggaggagccgagagccattgcagtggctccttcgctgggctggatgttctggagtgactggaacgagcgtaagcccaaggtggagcgcgcttcgctggatggatccgagcgtgtggttctggtctccgagaatctgggctggcccaatggcattgccttggatattgaggccaaggccatctactggtgcgatggcaagacggacaagatcgaggtggccaacatggatgggtctggccgacgagtggtgatcagcgacaatctgaagcatctgtttggcctgagcatcctggatgattacctatactggacagactggcaacgtcgatcgatagatcgcgcccacaagataacaggcaacaatcggatagtggttgtggatcagtatccggatttgatgggcctaaaggtgacacgtttgcgggaagtgaggggacagaatgcttgtgccgtgcgtaatggtggatgctcgcatctctgcctgaatcgtcccagggattatgtttgccgttgtgccattgattacgagctggccaacgacaagcgaacatgtgtggtgccagctgctttcctactattctcacgccaggagcacattggtcggatttctatagagtacaacgagggtaaccacaacgacgagcggataccgttcaaggatgtgcgggatgcacatgctctggatgtttctgtggctgagcgaaggatttactggacagatcagaagagcaagtgtattttccgagcctttttaaatggttcgtacgttcagcgaattgtggactcaggtctaattggtcctgatggcatcgctgtcgattggttggccaataatatttactggtcagatgcagaagcgcgtcgcattgaagttgctcgcctagatggcagcagtcggcgggtgcttctgtggaaaggagtggaggagccacgttccttggtcctagaaccgcgacgaggctatatgtactggacggaatcgccgacagattcgattcgcagagcggcaatggacggatctgacttgcagaccatcgtagcgggtgccaatcatgccgccggactaaccttcgaccaggagacaagacgtctgtactgggccacccaatcgcggccagctaaaatcgaaagtgctgattgggatggtaagaagcggcagatactggttggcagcgatatggatgagccgtatgcggtgtccttgtaccaagactatgtgtactggagcgactggaacactggagacattgagcgtgtgcacaagactacgggtcagaatcgcagcctggtgcactcgggcatgacgtacatcacctcgctgctggtgttcaacgataaacgccagacaggtgttaatccgtgcaaggtgaacaatggaggatgttcacatctctgcttggctcaacccggaagacggggcatgacctgcgcctgtcccactcactaccagttggccaaggacggcgtctcatgtattccgcccagaaactacattatcttcagtcagaggaactgttttgggcgattgctaccgaacactacggattgcccaaatattccactgcccgtttctggcaagaatattcgtgctgtggactatgatcccatcactcaccatatttattggattgaaggcagaagtcacagcatcaaacgatcacttgccaatgggaccaaagtcagcttattggccaattccggccagccttttgacctggccatcgacattattgggcgtctgctcttctggacttgctcccagtctaacagcatcaacgttactagtttcctgggcgaatccgttggcgtcatcgatacgggagattcagagaagcctcgcaacattgcagtgcatgccatgaagcgcctgctcttttggacagatgttggtagccatcaggctataatacgtgcccgagttgatggcaatgagcgcgtggagctggcttacaaactggagggcgtaactgccttagctttggatcagcagtccgatatgatttactatgcacatggcaagcggatcgatgccattgacatcaacggaaaaaacaaaaaaacacttgtttctatgcacatttcgcaagtgatcaacatcgctgccttgggtggctttgtctactggctggatgataaaaccggcgtggaacgtatcacggtgaatggcgaaagacgatctgctgaactgcagcgcctacctcagatcaccgatatccgggccgtttggacgccagatccgaaagtcctgcgaaatcacacgtgcatgcacagccgaaccaagtgctcgcacatctgtattgccagcggtgaaggaatcgctagaacccgcgacgtctgctcctgcccaaagcatctaatgttgctggaggacaaggagaactgtggcgcttttcccgcctgtggcccggatcattttacgtgcgcagctcccgtatcgggaatcagtgacgtgaacaaagactgcatcccagcctcgtggcgttgtgacggacagaaggactgtccggacaagtcagacgaggtgggttgtcccacttgccgggcagatcagttcagctgtcagtcgggcgagtgcatcgacaagtcgctggtgtgcgatggcaccaccaattgtgccaacggtcatgatgaagccgattgttgcaagcgaccaggggagttccagtgtcccattaacaagctctgcatctcggccgcactgctctgcgatggatgggagaactgcgccgatggagctgatgaatcctcggatatctgcctgcaacgccgcatggcacctgctaccgacaaacgtgcctttatgattttgattggcgctaccatgatcaccatattttcgattgtctatttgctgcagttctgtcgcacgcgtattggaaagagtcgaacagagcctaaggatgaccaggccactgatccattgtcaccctcgacgctgagcaaatcgcaaagggtttccaaaatcgcttcggttgcggatgcagtacgcatgtctacgctgaactcgcgcaacagcatgaattcctacgatcgcaatcatatcacaggcgcctcaagctcaacgacgaatggtagcagtatggtggcgtatccaatcaatccaccaccgtcgccagcaaccagatcgcgtcgcccgtacaggcactacaagatcatcaatcagcctccaccgccaacaccctgctcaacggacatttgtgatgagtctgactcgaattatacgagcaaatcgaacagcaataacagtaatgggggagccacaaagcattcttccagttcggcggccgcctgcttgcaatatggctacgatagtgagccgtatccgccgccgccgacaccacgctcccattaccacagcgatgtgcgcattgtgccggaatcctcctgcccgccatcgccgtcatcgcggagctccacgtacttctcgccgctcccgcctccgccatcaccagtacagtcgccgagtcggggatttacgtaa

SEQ ID NO: 104 - protein, 206 aa, HOMO SAPIENS
MLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 105 - protein, 206 aa, RAT
MLPPAIHLSLIPLLCILMKNCLAFKNDATEILYSHVVKPVSAHPSSNSTLNQARNGGRHFSSTGLDRNSRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESVSPAKPAQHHRERKRASKSSKHSLS

SEQ ID NO: 106 - protein, 126 aa, DANIO RERIO
GCRELRSTKYISDGQCTSLNPVKELVCAGECLPTHLLPNWIGGGHYWSRRDAQEWRCVTDRTRTQRIKLQCQDGTTRTYKITAVTSCTCKRYTRQNNESSHAPQSHSKDHPLQSPKKKKSKNKNSK

SEQ ID NO: 107 - protein, 213 aa, MONKEY
MQLPLALCLVCLLVHAAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGAAPRARKVRLVASCKCKRLTRFHNQSELKDFGPEAARPQKGRKPRPRARGAKANQAELENAY

SEQ ID NO: 108 - DNA, 618 bp, DROSOPHILA
atgcttctctccgccattcacttctacggcttactcctagcttgcaccttcacgagaagctactcggctttcaagaacgatgccactgagatactttattcccacgtcgttaaacctgcccctgcgagcccgagcagcaacagcacgttgaaccaagccaggaacggagggaggcactacgccggcacgggctccgaccgtaacaatcgcgttcaagttggctgccgggaactgcgatctaccaagtacatctcagacggccagtgcaccagcatcaatcccctgaaggagctggtgtgtgctggcgaatgcctccccttgccgctcctgcccaactggattggaggaggttatggaaccaagtactggagcagacggagctcgcaagagtggagatgtgtcaatgacaaaactcgcacccagaggatccagctgcagtgccaggatggaagtataagaacctacaaaataactgtggtcacggcctgcaagtgcaagcgatacaccaggcagcacaacgagtccagccacaactttgagggaacctctcaagcaaagcctgtccagcatcacaaagagagaaaaagagccagtaaatccagcaaacatagtacaagt

SEQ ID NO: 109 - protein, 176 aa, TAURUS
NDATEIIPELGEYPEPLPELNNKTMNRAENGGRPPHHPFETKDASEYSCRELHFTRYVTDGPCRSAKPVTELVCSGQCGPARLLPNAIGRGKWWRPSGPDFRCIPDRYRAQRVQLLCPGGAAPRARKVRLVASCKCKRLTRFHNQSELKDFGPEAARPQTGRKLRPRARGTKASRA

SEQ ID NO: 110 - DNA, 532 bp, TAURUS
agaatgatgccacagaaatcatccccgagctgggcgagtaccccgagcctctgccagagctgaacaacaagaccatgaaccgggcggagaacggagggagacctccccaccacccctttgagaccaaagacgcctccgagtacagctgccgggagctgcacttcacccgctacgtgaccgatgggccgtgccgcagcgccaagccggtcaccgagctggtgtgctcgggccagtgcggcccggcgcgcctgctgcccaacgccatcggccgcggcaagtggtggcgcccaagcgggcccgacttccgctgcatccccgaccgctaccgcgcgcagcgggtgcagctgttgtgtcctggcggcgcggcgccgcgcgcgcgcaaggtgcgcctggtggcctcgtgcaagtgcaagcgcctcactcgcttccacaaccagtccgagctcaaggacttcgggcccgaggccgcgcggccgcaaacgggccggaagctgcggccccgcgcccggggcaccaaagccagccgggccga

SEQ ID NO: 111 - DNA, 558 bp, FUGU
cgcggatggaaggtgctgaagaacgacgccacagagattttaccggactaccgggagcggagtccgcacgagccgatgacgcaggcggcgaacagcagcagtaacggcgggaaccgcgcgaagagcggcgggagaagcacgagctcggtgacctacagtgcctcggagctgagctgcagggagctgcgttccacccgctacgtcaccgatggatcttgccgcagcgccaaacccatcaaggagctggtgtgctcgggccagtgcctgccagcgcacctcatgcccaacaccatcggccgcggcaagtggtggcggagcaacacctcggagtaccgctgcatcccggctcactccaggaccaggaggatccagctgcagtgccccaacggcaacactcggacttacaaaatccgcatagtgacctcctgcaagtgtaagcggttcagggctcaccacaaccagtcggaggccaaggaggtcctgaggaggcagcggagcaagaagcgcacgtctcaaggacggagcaaaaacaacacgcctttgattgacaattcatac

SEQ ID NO: 112 - DNA, 6076 bp, XENOPUS
gaggagagggagaaggcgggacgaaagaggagaggggtacgaggccatgggagcagcctgaaagagtcctggttgcggacgaaggggtcggtaggggaaagcgcagcctggagtaagatggggattctcccgaaagtcgcgctgttgttttgctactgtttggtgtctgcttgggggtctcctttattgctttttgccaaccgaagggatgtccgattggttgatgctggtgcagcaaaactagagtctgttgttgtggtgagcagcttggaagatgcagctgctgttgactttctctattcacaaggtgttatttattggacggatgtaagcgaagagtccattaaacaaacattgtttaaccagagttctaactcacaaactgtagtaatcccgggcttggtctcccctgatggcctcgctgttgactgggttggcaagaaactttattggacagactccgaaaccaaccggatagaagttgcaaacctcaatggaacatacagaaaagtcctcttctggcaagatctggatcagccgagggcgatcgctctcgatcctgctcatggatacatgtactggacagattggggtgaaaccccccggatagaaagagctggaatggatggcagcacacgcaaagtcatagttgacaccgatatttattggcccaatggactgacaattgatttagacgaacaaaagctttactgggcagatgcaagcttagactttattcacaaagctaattgggatggctcatttaggcaaaaggtagttgaaggaagccttacacatccatttgctctgacgctgacaggaaaaaccttgtattggacggactggcagacaagatcaattcatgcctgcaacaaacgcacaggggagaaaaggcgagaaattcttacgattctcctctactctcctatggacattcaagggtatagtaaagagaggcagccatcgcaccctacaccatgtcgattgaatgctaatgggggttgctctcacctttgtcttttgtccccaagagagcccttttatagctgtacatgtgctacaggagatcaactgacagacgatggcaaaacttgcaaaacaggtgctgatgatgacttgctgcttgcacggagaactgaccttcgaaggatctcactagacatgccagattttacagacattgtcctgcaaattgatgacatcaggcacgcgattgccattgattatgacccaactgaaggatatatctattggactgatgatgaagttaaggctatccgccgtgcatatctggatggatcaggagtcgaaaccctggttacaactgaaatacagcaccctgacggcatagcggttgactgggtggctcgtaacctttattggactgacaccgggacagatcgtatagaggttactctgctgaatggcacttcaaggaaaattttaatatctgaaaacctggatgaaccgagagctattgttttaaacccattaactgggtatatgtattggacagattggggagaaaatccaaaaattgagtctgcttatctggatgggtcagaacggctggttcttgttaattcatcattgggatggcccaatggattagcactggatcttcaagatggcaaactttactggggagatgctaaaacagacaaaatagaggttatcagtgttgatggaagcaatcggaaaactctcttggaagacaaacttccacatatatttggctttacgttgctgggagattacatctactggacagactggcaaaggcgaagcattgaaagagttcacaaagtcagagcaagtcgagaaattattatagaccagctcccagatctaatgggtctgaaagctgcaagtgtctctaatacatttggtaccaatccatgcgctgacaataatggaggctgcagccacttatgcttcttttctccccggggagtccgatgttcctgccccataggactggagttacttagtgacatgaggacttgcattattcctgaagccttcttagtttttaccagtagagcaactatccataggatttccttagaaacaaacaacaatgatgtggcaattcctctcactggagtcaaagaggcatctgctctcgattttgacgtatctgataacagactttactggactgatatcaccacgcgggcaattagtagggcatttatgaatggaagctccgtagaacatgttattgagtttggcctggattacccagaaggtatggcagttgattggatgggcaagaacctttattggtcagatactggaacaaatcgtattgaagtttcacgactggatggactgtatcgtcaagttttggtttggaaagatttggataaccctagatccctggctttggatccagcaaagggatacatgtactggacagaatggggaggaaaaccaagaatagtaagagcctacatggatgggaccaacaacatcattttggttgataaagtgggtcgagccaatgacttaaccattgactatgctgatcaaaggctgtattggactgacctggatacaaatatgattgaatcttcaaacatgctaggagcggaaagagagatcattgcagatgacctgcctcatccctttggactaactcagtacagtgactatatctactggacagactggaacctccacagcatagaaagagcagacaaattaaatggcaataaccgcactttaatacaagaccacctagattttgtgatggatatcttggtctttcactcttccaggcaggatggtttaaatgactgcatgcagaatagcggacactgcagtcagctctgcttggctgtgccaaagggatccaaatgtagttgctcctctcattatacactagcctcaaacaaccgggattgcagcccaccttccaactttctgctgttcagtcagaaaactgccattaatcgaatgctattagatgagcagcagagtccagatataactcttccaatccatgggctgagaaatgtcaaggcaattagctatgaccctgcggatgggcttatctactgggtggatggaaggcagaacaacatcaagagatcaaaggatgatgggacacagtcgtttgtggtggtctctactccaaatcaaagccaaactcaagaaaagcagcctcatgacttgagtattgatatctacagccgcacattgtactggacttgtgaaggcacaaacaccatcaacgcaaataaacttaatggagagtctttaggagttgttcttcgaggagaaaatgacaagcctagagccatagctgtgaatgcagaacgagggtacatgtattttacaaacatgcaagagcgatccccaaagattgagagggcagcattcgatgggacagagcgtgaagtactgttttctacaggtctgatacgaccggttgctttggttgttgacaacaaactaggcaaacttttctgggttgatgccgacttaaaaagaattgaaagcagcgatctgtctggagccaatcgtgtaacgctagaagactctaacatccttcagccgatggggcttacaattcttggggattacctgtattggatcgataagcagcagcaaatgattgagagggtggagaaaacaaatggaattagaagaacgaaaattcaaggtcgcattgctcaccccactggtattcatgcagtggagagtgtcgacatgaacgagttctttgctcacccatgtcttaataacaatggaggttgctctcacatctgcattaccaaaggagatggtacccctagatgttcttgtccagttcatctggtcttactacaagacctgttaacatgtggagagccacccacttgctccccagagcagttcacttgtgcaacaggggacattgactgcattcccatgaactggcgttgtgatggcttctcagagtgtgatgaccatagtgatgaagaaaactgtcctgtgtgttcaagcaaccagttccagtgtgggaagggtcagtgcattgatgcccgtcagaaatgcaatggagagtttgattgccaggataagtcggatgaattggactgtgactctatctgccttcctgatcagttccgttgtgccagcggtcagtgtataatgacgagtcagcagtgcgacaccttccccgactgcagcgatagctctgatgagctgatttgtgacaagcctcctccagagaaaacgccatctcacagcagtgccatagggccagttattggcatcattctgtctgtctttgtcatgggtggcctgtattttgtatgccagcgagtggtatgtcacaggtatacagggccaaatggaccttttcctcacgagtacataagtggaactccacatgtccctctcaactttataactacaagaagctcacagcctaacacttacactggtatttcctatggcaagccaatgattggctcaatgagcatcatgggaggcagcagcggagccccactttatgataggaaccacgtgacaggagcctcatctagcagctcttccagcactaaggccacactataccctcaaatattgaatccacctccatcaccagcaacagatcgttctttatacaacacagaagtattttactcctcaaacagtccatctaccactagatcgtacagaccctaccttataagagggattgctcctccaacaacaccctgcagtacggatgtctgtgacagtgactacaccacaagcagatggaaagccaataaatactatatggatctaaactctgactccgacccttaccctcctccacctaccccacggagtcaatatatgtcagccgaggaaagctgcccgccttcccctaccacagagcggagttacttccatctctaccccccaccaccctctccatgcacagactcttcatgacccccacgaaaatggaacttgtgtccctccagtgtaaataatcttaaataagaacaaatatataaatatatatatattttaatgattttaaagataaatagaatttttttttataaaagagaaaataatcggaaaaaaaaatgtgaatacaatgggtttgggaaggggctgtgaaattgtacagtaaaaaatatttataattttgcttttcttttaatttaagtacagcatgccatgtttctaatggaaactaaaatgttaagtttgtatttacggcagacaaaagactctggaccctttttctgaataatgataagctgtgaggttgatgttttagcatttttattgtattcgttctagtgcccatgagttctgtttggtggttatatgtcaaggggccccaatccacttttattcacaggaataaatgccctacctagaataaccatgacacaaatacggaagtaaaatggatataaattctaatgacagctgcattaaggggctgacaagtttgcccaggagcagtaacccctagcaacctggtgatgcattgctctgagttactgctcctggacaaacttagtgtcttttataacataacccctttgacttttattgtgcactaatgtattatttatttaacaaagcaaccaaacatcaagttagaaaacccgattgttaaagaacatgacgcctctctttagtaggggagaagagataaaatggccagggccaaatgtaatgcaggtaagtgaggccccagtattggagaaaggactttatgggtcgggaacattcgttttacttgcctcatttagaagacaatatttttaatgtaattttgtatgtaaacagtgaggtgcgtcagaacatccaataatattaccaggtacacatacctgtttagcggtaagtctgccttctcttaaaggttttttttttgctctgcctttttcctcccagcaggcctgtgtgaacgatacaacaaatgtgcacgtttttttaatgcatgttaatatcatgaatgggttttacaaaaatataaccctgctttctccccttatcagaatatgaagtaattcaatgtctgcaaaaatgcaccataaagttatattctcgttaaaaaaaaaaaaaaaaa

SEQ ID NO: 113 - DNA, 1581 bp, RABBIT
aacgtgcagcggctgagcggggaggccgtgggggtggtgctgcgtgggggccgcgacaggcccagagccatcgtcgtcaacgccgagcgagggcacctgtacttcaccaacatgcaggaccgcgcggccaagatcgagcgcgcggccctggacggcacggagcgcgaggtcctcttcaccacgggcctcatccgccccgtggccctcgtggtggacaacgcgctgggcaagctcttctgggtggatgcggacctgaagcgcatcgagagctgcgacctctcaggggccaaccgcctgaccctggaggacgccagcatcgtgcagcccgtgggcctggccgtgctcggccggcacctctactgggccgaccggcagcagcagatgatcgagcgcgtggagaaggccaccggggacaagcgcacgcgcgtgcagggccgcgtggcccacctcaccggcatccacgcggtggaggaagtcagtctggaagagttctccgcccatccttgtgcccgagacaacggcggctgctcccacatctgcattgccaagggcgatgggacgccgcggtgctcctgccccgtccacctcgtgctgctgcagaacctgctcacctgtgcagagcctcccacctgctctcctgaccagttcgcctgtgccacgggggagatcgactgcatcccgggggcctggcgctgcgacggcttccccgagtgcgacgaccagagcgacgaggagggctgccccgtgtgctcggccgcccagttcccctgcgcgcgcggccagtgcgtggacctgcggctgcgctgcgacggcgaggccgactgccacgaccactcggacgaggccgactgcgacgccatctgcctgcccaaccagttccggtgcgccagcggccagtgcctgctcatccggcagcagtgcgactccttccccgactgcgtggacggctcggacgagctcatgtgtgagatcacccggccgcccgtggacgacatcccggctcatagcagtgccatcgggcccgtcatcggcattatcctgtccctgttcgtcatgggcggcgtttacttcgtgtgccagcgcgtggtgtgccagcgctacgcgggcgcaggtgggcccttcccgcatgagtacgtccgcgggaccccccacgtgcccctcaacttcatagccccaggcagctcccagcacggccgcttcacaggcatctcctgcggcaagtccatgatgagctccgtgagcttgatgggtggccgggccgccgtgcccctttacgagcggaaccacgtcaccggggcctcgtccagcgactcgtccagcacgaaggcctcgctgtacccgcagatcctgaacccgccgccatcccccgccacggacccctccctctacaacatggacgtgttctaccctgcaaacattccgcctgcggccacgccctacaggtcctacgtcatccgaggcatggcgcccccgaccacgccctgcagcaccgacgtgtgtgacagtgactacagtgccagccactggaaggccagcaggtactacctggatctgaactccgactcggacccctacccctcg

SEQ ID NO: 114 - protein, 56 aa, MOUSE
  misc_feature (22)..(22): Xaa can be any naturally occurring amino acid
  misc_feature (55)..(55): Xaa can be any naturally occurring amino acid
GCRELRSTKYISDGQCTSISPXKELVCAGECLPLPVLPNWIGGGYGTKYWSRRSXQ

SEQ ID NO: 115 - protein, 77 aa, MOUSE
EWRCVNDKTRTQRIQLQCQDGSTRTYKITVVTACKCKRYTRQHNESSHNFESVSPAKPAQHHRERKRASKSSKHSLS

SEQ ID NO: 116 - protein, 31 aa, MOUSE
  misc_feature (22)..(22): Xaa can be any naturally occurring amino acid
GCRELRSTKYISDGQCTSISPXKELVCAGEC

SEQ ID NO: 117 - protein, 28 aa, MOUSE
  misc_feature (24)..(24): Xaa can be any naturally occurring amino acid
LPLPVLPNWIGGGYGTKYWSRRSXQEWR

SEQ ID NO: 118 - protein, 43 aa, MOUSE
CVNDKTRTQRIQLQCQDGSTRTYKITVVTACKCKRYTRQHNES

SEQ ID NO: 119 - protein, 31 aa, MOUSE
SHNFESVSPAKPAQHHRERKRASKSSKHSLS

SEQ ID NO: 120 - protein, 52 aa, MOUSE
SCRELHYTRFLTDGPCRSAKPVTELVCSGQCGPARLLPNAIGRVKWWRPNGP

SEQ ID NO: 121 - protein, 83 aa, MOUSE
DFRCIPDRYRAQRVQLLCPGGAAPRSRKVRLVASCKCKRLTRFHNQSELKDFGPETARPQKGRKPRPGARGAKANQAELENAY

SEQ ID NO: 122 - protein, 31 aa, MOUSE
SCRELHYTRFLTDGPCRSAKPVTELVCSGQC

SEQ ID NO: 123 - protein, 24 aa, MOUSE
GPARLLPNAIGRVKWWRPNGPDFR

SEQ ID NO: 124 - protein, 44 aa, MOUSE
CIPDRYRAQRVQLLCPGGAAPRSRKVRLVASCKCKRLTRFHNQS

SEQ ID NO: 125 - protein, 36 aa, MOUSE
ELKDFGPETARPQKGRKPRPGARGAKANQAELENAY

SEQ ID NO: 126 - DNA, 618 bp, MOUSE; identical to SEQ ID NO: 1
  misc_feature (283)..(283): n is a, c, g, or t
  misc_feature (383)..(383): n is a, c, g, or t

SEQ ID NO: 127 - DNA, 213 bp, MOUSE
atgcttcctcctgccattcatctctctctcattcccctgctctgcatcctgatgagaaactgtttggcttttaaaaatgatgccacagaaatcctttattcacatgtggttaaacctgtcccggcacaccccagcagcaacagcaccctgaatcaagccaggaatggaggcaggcatttcagtagcactggactggatcgaaacagtcgagtt

SEQ ID NO: 128 - DNA, 405 bp, MOUSE
  misc_feature (70)..(70): n is a, c, g, or t
  misc_feature (170)..(170): n is a, c, g, or t
caagtgggctgcagggaactgcggtccaccaaatacatttcggacggccagtgcaccagcatcagccctntgaaggagctggtgtgcgcgggcgagtgcttgcccctgccggtgcttcccaactggatcggaggaggctatggaacaaagtactggagccggaggagctntcaggagtggcggtgtgtcaacgacaagacgcgcacccagaggatccagctgcagtgtcaggacggcagcacgcgcacctacaaaatcaccgtggtcacggcgtgcaagtgcaagaggtacacccgtcagcacaacgagtccagccacaactttgaaagcgtgtcgcccgccaagcccgcccagcaccacagagagcggaagagagccagcaaatccagcaagcacagtctgagc

SEQ ID NO: 129 - DNA, 20 bp, XENOPUS
  misc_feature (9)..(9): n is a, c, g, or t
  misc_feature (12)..(12): n is a, c, g, or t
gcttttaanaangatgccac

SEQ ID NO: 130 - DNA, 20 bp, XENOPUS
  misc_feature (6)..(6): n is a, c, g, or t
  misc_feature (9)..(9): n is a, c, g, or t
  misc_feature (12)..(12): n is a, c, g, or t
gtgacnacngtnattttgta

SEQ ID NO: 131 - DNA, 25 bp, XENOPUS
agcactggagccttgagacaaccat

SEQ ID NO: 132 - DNA, 25 bp, XENOPUS
agcagtgaagccttgagacaaccat

SEQ ID NO: 133 - DNA, 1718 bp, RAT; identical to SEQ ID NO: 12

SEQ ID NO: 134 - DNA, 25 bp, MOUSE
cgtgcctcatctgcctacttgtgca

SEQ ID NO: 135 - DNA, 27 bp, MOUSE
gaagtccttgagctccgactggttgtg

SEQ ID NO: 136 - DNA, 26 bp, MOUSE
ttctggcgagtcgacaattctattgg

SEQ ID NO: 137 - DNA, 26 bp, MOUSE
aacctttatcgtcgacgagcaattgg

SEQ ID NO: 138 - DNA, 44 bp, MOUSE
gcttcagcagcacatatggctgttgtttataacaacgaagggac

SEQ ID NO: 139 - DNA, 45 bp, MOUSE
gcagcttcagcagcggatccagctgttgtttataacaacgaaggg

SEQ ID NO: 140 - DNA, 35 bp, MOUSE
gcaaaaaaagcgaatctctcgagtcgccttgcttt

What is claimed is:

1. A method for modulating Sost binding to an LRP comprising contacting a Sost polypeptide or a nucleic acid encoding a Sost polypeptide with an agent that binds to the Sost polypeptide or nucleic acid encoding the Sost polypeptide and prevents or decreases Sost polypeptide binding to an LRP selected from the group consisting of LRP 1-11 and Arrow.

2. The method according to claim 1, wherein the agent is selected from the group consisting of a monoclonal antibody, a Fv fragment of an antibody, a Fab fragment of an antibody, a $Fab_2$ fragment of an antibody, and an antibody combining region.

3. The method according to claim 2, wherein the agent is a monoclonal antibody, or a Fab fragment thereof.

4. The method according to claim 3, wherein the monoclonal antibody, or a Fab fragment thereof specifically binds to a Sost polypeptide that is encoded by a nucleic acid sequence of SEQ ID NO: 10.

5. The method according to claim 3, wherein the monoclonal antibody, or a Fab fragment thereof prevents or decreases Sost binding to an LRP selected from the group consisting of SEQ ID Nos: 81-82.

6. The method according to claim 1, wherein the LRP is selected from the group consisting of LRP 1, 2, 5, and 6.

7. The method according to claim 1, wherein the LRP is selected from the group consisting of LRP 5 and 6.

8. The method according to claim 1, wherein the LRP is LRP5.

9. The method according to claim 1, wherein the LRP is LRP6.

* * * * *